US012600967B2

(12) United States Patent
Samarsky

(10) Patent No.: US 12,600,967 B2
(45) Date of Patent: Apr. 14, 2026

(54) SIRNA COMPOUND THAT INHIBITS COMPLEMENT FACTOR B (CFB)

(71) Applicant: Sirnaomics, Inc., Gatithersburg, MD (US)

(72) Inventor: Dmitry Samarsky, Gaithersburg, MD (US)

(73) Assignee: SIRNAOMICS, INC., Gaithersburg, MD (US)

(*) Notice: Subject to any disclaimer, the term of this patent is extended or adjusted under 35 U.S.C. 154(b) by 0 days.

(21) Appl. No.: 17/867,404

(22) Filed: Jul. 18, 2022

(65) Prior Publication Data

US 2023/0135763 A1 May 4, 2023

Related U.S. Application Data

(60) Provisional application No. 63/318,341, filed on Mar. 9, 2022, provisional application No. 63/222,974, filed on Jul. 17, 2021.

(51) Int. Cl.
*C12N 15/113* (2010.01)
*A61K 31/712* (2006.01)

(52) U.S. Cl.
CPC .......... *C12N 15/113* (2013.01); *A61K 31/712* (2013.01); *C12N 2310/14* (2013.01); *C12N 2310/315* (2013.01); *C12N 2310/531* (2013.01)

(58) Field of Classification Search
CPC .............. C12N 15/113; C12N 2310/14; C12N 2310/315; C12N 2310/531; C12N 2310/351; A61K 31/712
See application file for complete search history.

(56) References Cited

U.S. PATENT DOCUMENTS

| | | | | |
|---|---|---|---|---|
| 2007/0088154 A1 | 4/2007 | Khvorova et al. | |
| 2016/0222389 A1* | 8/2016 | Grossman ............... | A61P 13/00 |
| 2016/0298124 A1* | 10/2016 | Borodovsky ........... | A61P 11/06 |

FOREIGN PATENT DOCUMENTS

| | | | |
|---|---|---|---|
| WO | 2014/107763 A1 | 7/2014 |
| WO | 2015/038939 A2 | 3/2015 |
| WO | 2015/168635 A2 | 11/2015 |
| WO | 2018/117253 A1 | 6/2018 |
| WO | 2019/027015 A1 | 2/2019 |
| WO | 2021/222549 A1 | 11/2021 |
| WO | 2023/018523 A2 | 2/2023 |

OTHER PUBLICATIONS

Girard et al. A germline-specific class of small RNAs binds mammalian Piwi proteins, 2006, Nature, vol. 442, p. 199-202 (Year: 2006).*

Zheng et al., Single modification at position 14 of siRNA strand abolishes its gene-silencing activity by decreasing both RISC loading and target degradation 2013, Faseb J., 27, 4017-4026 (Year: 2013).*

International Search Report and the Written Opinion in PCT/US2022/037478, Jun. 16, 2023, 12 pages.

Partial Supplemental European Search Report issued in corresponding European Patent Application No. 22856401.9, dated Apr. 10, 2025, 19 pages.

Wang, X. et al., "Complement factor B knockdown by short hairpin RNA inhibits laser-induced choroidal neovascularization in rats", Int J Ophthalmol., vol. 13(3), pp. 382-389 (2018).

Huan, T. et al., "Construction and 1,4-8, assessment of recombinant plasmid 11-15 pRNAT-U6.1/CFB siRNA and its inhibitory effect on proliferation of human umbilical vein endothelial cells", Chin J Exp Ophthalmol., vol. 33(8), pp. 686-690 (2015).

Poppelaars, F. et al., "Complement-mediated kidney diseases", Mol Immunol, vol. 128, pp. 175-187 (2020).

* cited by examiner

*Primary Examiner* — Soren Harward
*Assistant Examiner* — Keyur A Vyas
(74) *Attorney, Agent, or Firm* — Edell, Shapiro & Finnan, LLC

(57) ABSTRACT

Nucleic acid products that modulate, in particular interfere with or inhibit CFB gene expression, are provided. The products may be oligomeric compounds that comprise at least a first region of linked nucleosides having at least a first nucleobase sequence that is at least partially complementary to at least a portion o 5 f RNA transcribed from a CFB gene, where the first nucleobase sequence is selected from SEQ ID NOs 1 to 391, 751 and 752, or a fragment thereof.

9 Claims, 9 Drawing Sheets

Specification includes a Sequence Listing.

SIRNA COMPOUND THAT INHIBITS COMPLEMENT FACTOR B (CFB)

CROSS REFERENCE TO RELATED PATENT APPLICATIONS

This application claims the benefit of and priority to U.S. Provisional Patent Application No. 63/318,341, filed Mar. 9, 2022, and U.S. Provisional Patent Application No. 63/222,974, filed Jul. 17, 2021, the contents of which are incorporated herein by reference in their entirety.

SEQUENCE LISTING

The instant application contains a Sequence Listing which has been submitted electronically in ST.26 (XML) format and is hereby incorporated by reference in its entirety. Said Sequence List, created on Aug. 10, 2023, is named 4690_0055C_SL.xml and is 5,650,369 bytes in size.

FIELD

Nucleic acid products are provided that modulate, in particular interfere with or inhibit, complement factor B (CFB) gene expression. Compositions containing the nucleic acids also are provided, together with methods for their use to treat, prevent, or ameliorate complement system-associated including CFB-associated disorders such as auto-immune diseases, age-related macular degeneration (AMD), paroxysmal nocturnal hemoglobinuria (PNH), atypical hemolytic uremic syndrome (aHUS), and C3 glomerulopathy (C3G).

BACKGROUND

The complement system is part of the innate immune system. Compared to the adaptive immune system, it is evolutionary older and conserved across most taxa. Its function includes decorating microbes of potentially pathogenic nature (a process referred to as opsonization) and target them for destruction, which is effected by a macromolecular assembly known as the membrane attachment complex (MAC). Certain components of the complement system, once activated, contribute to chemoattraction and activation of leukocytes.

Complement activation may be triggered by various factors which all involve presence of microbes but may also involve components of the adaptive immune system such as Ig including IgM. Three main pathways of complement activation have been recognized and are referred to as classical pathway, alternative pathway and lectin pathway.

In functional terms, complement activation occurs inherently at a low level (spontaneous cleavage of C3 to yield C3a and C3b) and is reinforced in the presence of microbes via an enzymatic cascade converting inactive forms of enzymes (zymogenes) into their active counterparts. The term “convertase”, such as C3 convertase, is primarily a functional term and may refer to structurally distinct complexes. One type of C3 convertases is a complex of C3b and complement factor B (CFB, Factor B). Once formed, a C3 convertase can convert large amounts of C3 into its cleavage products C3a and C3b within short amount of time. The specific C3 convertase which is a complex of C3b and Factor B has originally been described in the context of the alternative pathway, but may form also in the context of the other two pathways. Within the alternative pathway, Factor B is also a constituent of C5 convertase, a complex which converts C5, a more downstream component of the pathway, into its active form.

Disease

The complement system is generally triggered by patterns of binding sites on surfaces. These binding sites may be constituents of a microbe or pathogen, but may also be antibodies which previously bound to any target. In the latter case, the complement system acts to reinforce the adaptive immune system. As a consequence, and in case the mentioned antibodies are autoantibodies, the complement system exacerbates an undesirable auto-immune reaction. Interfering with the complement system in such a setting is a way to treat or ameliorate autoimmune diseases. Since the complement system, more specifically C1 of the classical pathway recognizes the constant portions of antibodies, interfering with the complement system opens an avenue to generally interfering with auto-immune disorder without particular limitation. Having said that, experience tells that auto-immune disorders affect skin, joints and kidneys more frequently than other organs.

On the other hand, complement dysfunction, in the absence of autoantibodies may be a trigger of disorders as well. Also in this context it applies that, owing to the generic mechanism of the complement system, the disease amenable to treatment by an inhibitor of the complement system, more specifically by an inhibitor of Factor B (CFB) is not particularly limited.

Treatment

Eculizumab is a humanized monoclonal antibody targeting C5 and has been approved for PNH treatment. A murine cell line is used for its production. Eculizumab shall not be used in patients with sensitivity against murine proteins. Treatment with eculizumab is very expensive and costs may exceed 600000 EUR per year and patient.

There therefore remains a need for therapies to treat complement-associated diseases including Factor B-associated diseases. We, therefore, aim to provide compounds, methods, and pharmaceutical compositions for the treatment of such diseases.

Double-stranded RNA (dsRNA) able to complementarily bind expressed mRNA has been shown to be able to block gene expression (Fire et al., 1998, Nature. 1998 Feb. 19; 391 (6669):806-1 1 and Elbashir et at., 2001, Nature. 2001 May 24; 41 1 (6836):494-8) by a mechanism that has been termed RNA interference (RNAi). Short dsRNAs direct gene-specific, post-transcriptional silencing in many organisms, including vertebrates, and have become a useful tool for studying gene function. RNAi is mediated by the RNA-induced silencing complex (RISC), a sequence-specific, multi-component nuclease that destroys messenger RNAs homologous to the silencing trigger loaded into the RISC complex.

Interfering RNA (iRNA) such as siRNAs, antisense RNA, and micro-RNA are oligonucleotides that prevent the formation of proteins by gene-silencing i.e. inhibiting gene translation of the protein through degradation of mRNA molecules. Gene-silencing agents are becoming increasingly important for therapeutic applications in medicine.

According to Watts and Corey in the Journal of Pathology (2012; Vol 226, p 365-379) there are algorithms that can be used to design nucleic acid silencing triggers, but all of these have severe limitations. It may take various experimental methods to identify potent siRNAs, as algorithms do not take into account factors such as tertiary structure of the target mRNA or the involvement of RNA binding proteins. Therefore, the discovery of a potent nucleic acid silencing trigger with minimal off-target effects is a complex process. For the pharmaceutical development of these highly charged molecules it is necessary that they can be synthesised economically, distributed to target tissues, enter cells and function within acceptable limits of toxicity. An aim is to, therefore, provide compounds, methods, and pharmaceutical compositions for the treatment of thromboembolic diseases as described herein, which comprise oligomeric compounds that modulate, in particular inhibit, gene expression by RNAi.

SUMMARY

Nucleic acid products are provided that modulate, in particular, interfere with or inhibit, complement factor B (CFB) gene expression, together with associated therapeutic uses. Specific oligomeric compounds and sequences are described herein. This summary is not intended to identify key features or essential features of the claimed subject matter, nor is it intended to be used to determine the scope of the claimed subject matter.

DETAILED DESCRIPTION

Figure 1:
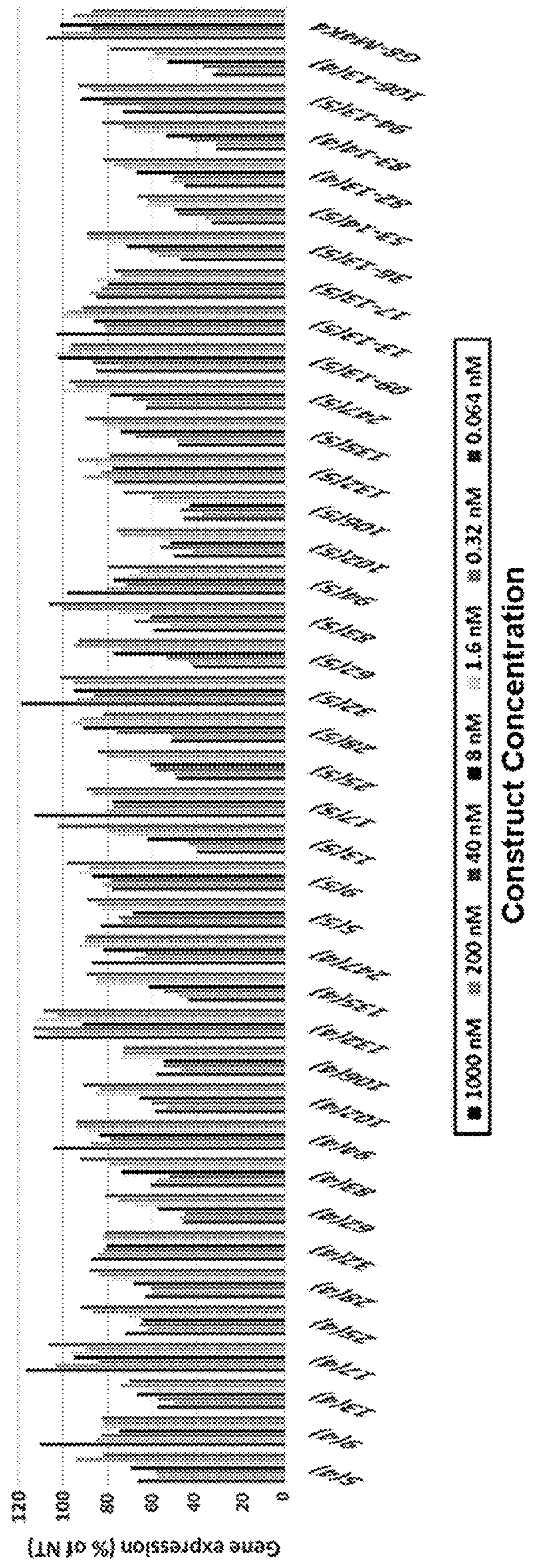
FIG. 1 shows sequence structure optimization in terms of reduction in CFB gene expression.

The following are non-limiting aspects.

Aspect 1. An oligomeric compound capable of inhibiting expression of CFB, where the compound comprises at least a first region of linked nucleosides having at least a first nucleobase sequence that is at least partially complementary to at least a portion of RNA transcribed from a CFB gene, where the first nucleobase sequence is selected from the following sequences, or a portion thereof: sequences of SEQ ID NOs 1 to 250, 751 and 752, where the portion advantageously has a length of at least 18 nucleotides.

Particularly advantageous embodiments relate to optimized hairpin RNAs (referred to as mxRNAs); for further details see the embodiments and their discussion further below.

In addition, the antisense and sense regions disclosed herein may serve as building blocks for compounds which are directed to multiple targets. The general architecture of such compounds is described in WO 2020/065602.

Furthermore, and as disclosed further below, double-stranded RNAs (dsRNAs) are provided. Distinct from mxRNAs, dsRNAs lack a loop connecting antisense and sense portions and therefore comprise two strands. These two strands are not covalently connected to each other, but form a duplex region where base pairing occurs.

Aspect 2. A composition comprising an oligomeric compound according to aspect 1, and a physiologically acceptable excipient.

Aspect 3. A pharmaceutical composition comprising an oligomeric compound according to aspect 1.

Aspect 4. An oligomeric compound according to aspect 1, for use in human or veterinary medicine or therapy.

Aspect 5. An oligomeric compound according to aspect 1, for use in a method of treating a disease or disorder.

Aspect 6. A method of treating a disease or disorder comprising administration of an oligomeric compound according to aspect 1, to an individual in need of treatment.

Aspect 7. Use of an oligomeric compound according to aspect 1, for use in research as a gene function analysis tool.

Aspect 8. Use of an oligomeric compound according to aspect 1 in the manufacture of a medicament for a treatment of a disease or disorder.

Further embodiments (items) are described below by way of example only.

It will be understood that the benefits and advantages described herein may relate to one embodiment or may relate to several embodiments. The embodiments are not limited to those that solve any or all of the stated problems or those that have any or all of the stated benefits and advantages.

Features of different aspects and embodiments as described herein may be combined as appropriate, as would be apparent to a skilled person, and may be combined with any other aspects.

Definitions

Unless specific definitions are provided, the nomenclature used in connection with, and the procedures and techniques of, analytical chemistry, synthetic organic chemistry, and medicinal and pharmaceutical chemistry described herein are those well known and commonly used in the art. Standard techniques may be used for chemical synthesis, and chemical analysis. Certain such techniques and procedures may be found for example in "Carbohydrate Modifications in Antisense Research" Edited by Sangvi and Cook, American Chemical Society, Washington D.C., 1994; "Remington's Pharmaceutical Sciences," Mack Publishing Co., Easton, Pa., 21st edition, 2005; and "Antisense Drug Technology, Principles, Strategies, and Applications" Edited by Stanley T. Crooke, CRC Press, Boca Raton, Florida; and Sambrook et al., "Molecular Cloning, A laboratory Manual," 2nd Edition, Cold Spring Harbor Laboratory Press, 1989, which are hereby incorporated by reference for any purpose. Where permitted, all patents, applications, published applications and other publications and other data referred to throughout in the disclosure are incorporated by reference herein in their entirety.

Unless otherwise indicated, the following terms have the following meanings:

As used herein, "excipient" means any compound or mixture of compounds that is added to a composition as provided herein that is suitable for delivery of an oligomeric compound.

As used herein, "nucleoside" means a compound comprising a nucleobase moiety and a sugar moiety. Nucleosides include, but are not limited to, naturally occurring nucleosides (as found in DNA and RNA) and modified nucleosides. Nucleosides may be linked to a phosphate moiety, phosphate-linked nucleosides also being referred to as "nucleotides".

As used herein, "chemical modification" or "chemically modified" means a chemical difference in a compound when compared to a naturally occurring counterpart. Chemical modifications of oligonucleotides include nucleoside modifications (including sugar moiety modifications and nucleobase modifications) and internucleoside linkage modifications. In reference to an oligonucleotide, chemical modification does not include differences only in nucleobase sequence.

As used herein, "furanosyl" means a structure comprising a 5-membered ring comprising four carbon atoms and one oxygen atom.

As used herein, "naturally occurring sugar moiety" means a ribofuranosyl as found in naturally occurring RNA or a deoxyribofuranosyl as found in naturally occurring DNA. A "naturally occurring sugar moiety" as referred to herein is also termed as an "unmodified sugar moiety". In particular, such a "naturally occurring sugar moiety" or an "unmodified sugar moiety" as referred to herein has a —H (DNA sugar moiety) or —OH (RNA sugar moiety) at the 2'-position of the sugar moiety, especially a —H (DNA sugar moiety) at the 2'-position of the sugar moiety. As used herein, "sugar moiety" means a naturally occurring sugar moiety or a modified sugar moiety of a nucleoside. As used herein, "modified sugar moiety" means a substituted sugar moiety or a sugar surrogate.

As used herein, "substituted sugar moiety" means a furanosyl that has been substituted. Substituted sugar moieties include, but are not limited to furanosyls comprising substituents at the 2'-position, the 3'-position, the 5'-position and/or the 4'-position. Certain substituted sugar moieties are bicyclic sugar moieties.

As used herein, "2'-substituted sugar moiety" means a furanosyl comprising a substituent at the 2'-position other than H or OH. Unless otherwise indicated, a 2'-substituted sugar moiety is not a bicyclic sugar moiety (i.e., the 2'-substituent of a 2'-substituted sugar moiety does not form a bridge to another atom of the furanosyl ring).

As used herein, "MOE" means —OCH2CH2OCH3.

As used herein, "2'-F nucleoside" refers to a nucleoside comprising a sugar comprising fluorine at the 2' position. Unless otherwise indicated, the fluorine in a 2'-F nucleoside is in the ribo position (replacing the OH of a natural ribose). Duplexes of uniformly modified 2'-fluorinated (ribo) oligonucleotides hybridized to RNA strands are not RNase H substrates while the ara analogs retain RNase H activity.

As used herein the term "sugar surrogate" means a structure that does not comprise a furanosyl and that is capable of replacing the naturally occurring sugar moiety of a nucleoside, such that the resulting nucleoside sub-units are capable of linking together and/or linking to other nucleosides to form an oligomeric compound which is capable of hybridizing to a complementary oligomeric compound. Such structures include rings comprising a different number of atoms than furanosyl (e.g., 4, 6, or 7-membered rings); replacement of the oxygen of a furanosyl with a non-oxygen atom (e.g., carbon, sulfur, or nitrogen); or both a change in the number of atoms and a replacement of the oxygen. Such structures may also comprise substitutions corresponding to those described for substituted sugar moieties (e.g., 6-membered carbocyclic bicyclic sugar surrogates optionally comprising additional substituents). Sugar surrogates also include more complex sugar replacements (e.g., the non-ring systems of peptide nucleic acid). Sugar surrogates include without limitation morpholinos, cyclohexenyls and cyclohexitols.

As used herein, "bicyclic sugar moiety" means a modified sugar moiety comprising a 4 to 7 membered ring (including but not limited to a furanosyl) comprising a bridge connecting two atoms of the 4 to 7 membered ring to form a second ring, resulting in a bicyclic structure. In certain embodiments, the 4 to 7 membered ring is a sugar ring. In certain embodiments the 4 to 7 membered ring is a furanosyl. In certain such embodiments, the bridge connects the 2'-carbon and the 4 '-carbon of the furanosyl.

As used herein, "nucleotide" means a nucleoside further comprising a phosphate linking group.

As used herein, "linked nucleosides" may or may not be linked by phosphate linkages and thus includes, but is not limited to "linked nucleotides." As used herein, "linked nucleosides" are nucleosides that are connected in a continuous sequence (i.e. no additional nucleosides are present between those that are linked).

As used herein, "nucleobase" means a group of atoms that can be linked to a sugar moiety to create a nucleoside that is capable of incorporation into an oligonucleotide, and where the group of atoms is capable of bonding, more specifically hydrogen bonding, with a complementary naturally occurring nucleobase of another oligonucleotide or nucleic acid. Nucleobases may be naturally occurring or may be modified.

As used herein the terms, "unmodified nucleobase" or "naturally occurring nucleobase" means the naturally occurring heterocyclic nucleobases of RNA or DNA: the purine bases adenine (A) and guanine (G), and the pyrimidine bases thymine (T), cytosine (C) (including 5-methyl C), and uracil (U).

As used herein, "modified nucleobase" means any nucleobase that is not a naturally occurring nucleobase.

As used herein, "modified nucleoside" means a nucleoside comprising at least one chemical modification compared to naturally occurring RNA or DNA nucleosides. Modified nucleosides can comprise a modified sugar moiety and/or a modified nucleobase.

As used herein, "bicyclic nucleoside" or "BNA" means a nucleoside comprising a bicyclic sugar moiety.

As used herein, "locked nucleic acid nucleoside" or "LNA" means a nucleoside comprising a bicyclic sugar moiety comprising a 4'-$CH_2$—O-2'bridge.

As used herein, "2 '-substituted nucleoside" means a nucleoside comprising a substituent at the 2'-position of the sugar moiety other than H or OH. Unless otherwise indicated, a 2 '-substituted nucleoside is not a bicyclic nucleoside.

As used herein, "deoxynucleoside" means a nucleoside comprising 2'-H furanosyl sugar moiety, as found in naturally occurring deoxyribonucleosides (DNA). In certain embodiments, a 2'-deoxynucleoside may comprise a modified nucleobase or may comprise an RNA nucleobase (e.g., uracil).

As used herein, "oligonucleotide" means a compound comprising a plurality of linked nucleosides. In certain embodiments, an oligonucleotide comprises one or more unmodified ribonucleosides (RNA) and/or unmodified deoxyribonucleosides (DNA) and/or one or more modified nucleosides.

As used herein, "modified oligonucleotide" means an oligonucleotide comprising at least one modified nucleoside and/or at least one modified internucleoside linkage.

Advantageous modified internucleoside linkages include those which confer increased stability as compared to the naturally occurring phosphodiesters. "Stability" refers in particular to stability against hydrolysis including enzyme-catalyzed hydrolysis, enzymes including exonucleases and endonucleases.

Advantageously, such modified internucleoside linkages may be placed at the termini and/or the hairpin loop of single-stranded oligomeric compounds as described herein. For example, the internucleoside linkages connecting first and second nucleoside and second and third nucleoside counting from the 5' terminus, and/or the internucleoside linkages connecting first and second nucleoside and second and third nucleoside counting from the 3' terminus are modified. In addition, a linkage connecting the terminal nucleoside of the 3' terminus with a ligand, such as GalNAc, may be modified.

As discussed above, advantageous positions are in the hairpin loop of the single-stranded oligomeric compounds. In particular, all linkages, all but one linkages or the majority of linkages in the hairpin loop are modified. As used herein, "linkages in the hairpin loop" designates the linkages between nucleosides which are not engaged in base pairing. For example, in a hairpin loop consisting of five nucleosides, there are four linkages between nucleosides which are not engaged in base pairing. "Linkages in the hairpin loop" may also extend to the linkages connecting the stem to the loop, i.e., those linkages which connect a base-paired nucleoside to a non-based paired nucleoside. Generally, there are two such positions in hairpins and mxRNAs as described herein.

Advantageously the modified internucleoside linkages are at both termini and in the hairpin loop.

As used herein, "linkage" or "linking group" means a group of atoms that link together two or more other groups of atoms.

As used herein "internucleoside linkage" means a covalent linkage between adjacent nucleosides in an oligonucleotide.

As used herein "naturally occurring internucleoside linkage" means a 3' to 5' phosphodiester linkage. As used herein, "modified internucleoside linkage" means any internucleoside linkage other than a naturally occurring internucleoside linkage. In particular, a "modified internucleoside linkage" as referred to herein can include a modified phosphorous linking group such as a phosphorothioate or phosphorodithioate internucleoside linkage.

As used herein, "terminal internucleoside linkage" means the linkage between the last two nucleosides of an oligonucleotide or defined region thereof.

As used herein, "phosphorus linking group" means a linking group comprising a phosphorus atom and can include naturally occurring phosphorous linking groups as present in naturally occurring RNA or DNA, such as phosphodiester linking groups, or modified phosphorous linking groups that are not generally present in naturally occurring RNA or DNA, such as phosphorothioate or phosphorodithioate linking groups. Phosphorus linking groups can therefore include without limitation, phosphodiester, phosphorothioate, phosphorodithioate, phosphonate, methylphosphonate, phosphoramidate, phosphorothioamidate, thionoalkylphosphonate, phosphotriesters, thionoalkylphosphotriester and boranophosphate.

As used herein, "internucleoside phosphorus linking group" means a phosphorus linking group that directly links two nucleosides.

As used herein, "oligomeric compound" means a polymeric structure comprising two or more substructures. In certain embodiments, an oligomeric compound comprises an oligonucleotide, such as a modified oligonucleotide. In certain embodiments, an oligomeric compound further comprises one or more conjugate groups and/or terminal groups and/or ligands. In certain embodiments, an oligomeric compound consists of an oligonucleotide. In certain embodiments, an oligomeric compound comprises a backbone of one or more linked monomeric sugar moieties, where each linked monomeric sugar moiety is directly or indirectly attached to a heterocyclic base moiety. In certain embodiments, oligomeric compounds may also include monomeric sugar moieties that are not linked to a heterocyclic base moiety, thereby providing abasic sites. Oligomeric compounds may be defined in terms of a nucleobase sequence only, i.e., by specifying the sequence of A, G, C, U (or T). In such a case, the structure of the sugar-phosphate backbone is not particularly limited and may or may not comprise modified sugars and/or modified phosphates. On the other hand, oligomeric compounds may be more comprehensively defined, i.e, by specifying not only the nucleobase sequence, but also the structure of the backbone, in particular the modification status of the sugars (unmodified, 2'-OMe modified, 2'-F modified etc.) and/or of the phosphates.

As used herein, "terminal group" means one or more atom attached to either, or both, the 3 'end or the 5' end of an oligonucleotide. In certain embodiments, a terminal group comprises one or more terminal group nucleosides.

As used herein, "conjugate" or "conjugate group" means an atom or group of atoms bound to an oligonucleotide or oligomeric compound. In certain embodiments, a conjugate group links a ligand to a modified oligonucleotide or oligomeric compound. In general, conjugate groups can modify one or more properties of the compound to which they are attached, including, but not limited to pharmacodynamic, pharmacokinetic, binding, absorption, cellular distribution, cellular uptake, charge and/or clearance properties.

As used herein, "conjugate linker" or "linker" in the context of a conjugate group means a portion of a conjugate group comprising any atom or group of atoms and which covalently link an oligonucleotide to another portion of the conjugate group. In certain embodiments, the point of attachment on the oligomeric compound is the 3 '-oxygen atom of the 3'-hydroxyl group of the 3' terminal nucleoside of the oligonucleotide. In certain embodiments the point of attachment on the oligomeric compound is the 5'-oxygen atom of the 5'-hydroxyl group of the 5' terminal nucleoside of the oligonucleotide. In certain embodiments, the bond for forming attachment to the oligomeric compound is a cleavable bond. In certain such embodiments, such cleavable bond constitutes all or part of a cleavable moiety.

In certain embodiments, conjugate groups comprise a cleavable moiety (e.g., a cleavable bond or cleavable nucleoside) and ligand portion that can comprise one or more ligands, such as a carbohydrate cluster portion, such as an N-Acetyl-Galactosamine, also referred to as "GalNAc", cluster portion. In certain embodiments, the carbohydrate cluster portion is identified by the number and identity of the ligand. For example, in certain embodiments, the carbohydrate cluster portion comprises 2 GalNAc groups. For example, in certain embodiments, the carbohydrate cluster portion comprises 3 GalNAc groups. In certain embodiments, the carbohydrate cluster portion comprises 4 GalNAc groups. Such ligand portions are attached to an oligomeric compound via a cleavable moiety, such as a cleavable bond or cleavable nucleoside. The ligands can be arranged in a linear or branched configuration, such as a biantennary or triantennary configurations. An example of a carbohydrate cluster has the following formula:

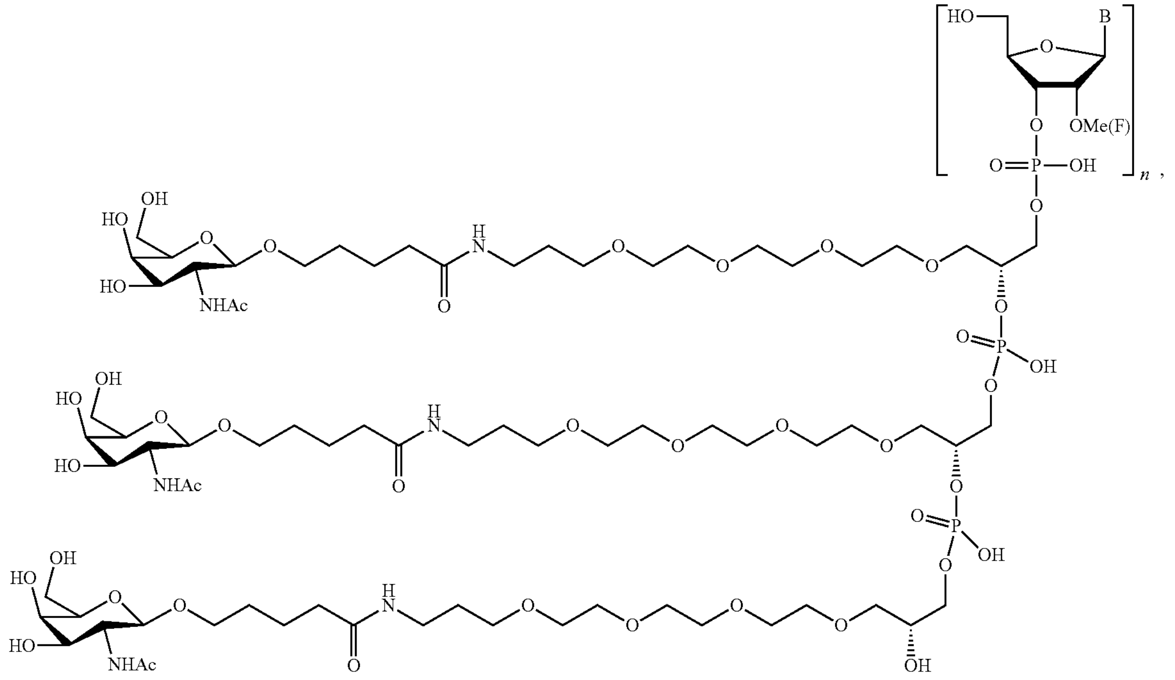

where in the structural formula one, two, or three phosphodiester linkages can also be substituted by phosphothionate linkages.

As used herein, "cleavable moiety" means a bond or group that is capable of being cleaved under physiological conditions. In certain embodiments, a cleavable moiety is cleaved inside a cell or sub-cellular compartments, such as an endosome or lysosome. In certain embodiments, a cleavable moiety is cleaved by endogenous enzymes, such as nucleases. In certain embodiments, a cleavable moiety comprises a group of atoms having one, two, three, four, or more than four cleavable bonds. In certain embodiments, a cleavable moiety is a phosphodiester linkage.

As used herein, "cleavable bond" means any chemical bond capable of being broken.

As used herein, "carbohydrate cluster" means a compound having one or more carbohydrate residues attached to a linker group.

As used herein, "modified carbohydrate" means any carbohydrate having one or more chemical modifications relative to naturally occurring carbohydrates.

As used herein, "carbohydrate derivative" means any compound which may be synthesized using a carbohydrate as a starting material or intermediate.

As used herein, "carbohydrate" means a naturally occurring carbohydrate, a modified carbohydrate, or a carbohydrate derivative. A carbohydrate is a biomolecule including carbon (C), hydrogen (H) and oxygen (O) atoms. Carbohydrates can include monosaccharide, disaccharides, trisaccharides, tetrasaccharides, oligosaccharides or polysaccharides, such as one or more galactose moieties, one or more lactose moieties, one or more N-Acetyl-Galactosamine moieties, and/or one or more mannose moieties. Advantageously the carbohydrate is N-Acetyl-Galactosamine.

As used herein, "strand" means an oligomeric compound comprising linked nucleosides.

As used herein, "single strand" or "single-stranded" means an oligomeric compound comprising linked nucleosides that are connected in a continuous sequence without a break therebetween.

Such single strands may include regions of sufficient self-complementarity so as to be capable of forming a stable self-duplex in a hairpin structure.

As used herein, "hairpin" means a single stranded oligomeric compound that includes a duplex formed by base pairing between sequences in the strand that are self-complementary and opposite in directionality.

As used herein, "hairpin loop" means an unpaired loop of linked nucleosides in a hairpin that is created as a result of hybridization of the self-complementary sequences. The resulting structure looks like a loop or a U-shape.

In particular, short hairpin RNA, also denoted as shRNA, comprises a duplex region and a loop connecting the regions forming the duplex. The end of the duplex region which does not carry the loop may be blunt-ended or carry (a) 3' and/or (a) 5' overhang(s). Blunt-ended constructs are particularly advantageous.

As used herein, "directionality" means the end-to-end chemical orientation of an oligonucleotide based on the chemical convention of numbering of carbon atoms in the sugar moiety meaning that there will be a 5'-end defined by the 5' carbon of the sugar moiety, and a 3'-end defined by the 3' carbon of the sugar moiety. In a duplex or double stranded oligonucleotide, the respective strands run in opposite 5' to 3' directions to permit base pairing between them.

As used herein, "duplex", or also abbreviated as "dup", means two or more complementary strand regions, or strands, of an oligonucleotide or oligonucleotides, hybridized together by way of non-covalent, sequence-specific interaction therebetween. Most commonly, the hybridization in the duplex will be between nucleobases adenine (A) and thymine (T), and/or (A) adenine and uracil (U), and/or guanine (G) and cytosine (C). The duplex may be part of a single stranded structure, where self-complementarity leads to hybridization, or as a result of hybridization between respective strands in a double stranded construct.

As used herein, "double strand" or "double stranded" means a pair of oligomeric compounds that are hybridized to one another. In certain embodiments, a double-stranded oligomeric compound comprises a first and a second oligomeric compound.

As used herein, "expression" means the process by which a gene ultimately results in a protein.

Expression includes, but is not limited to, transcription, post-transcriptional modification (e.g., splicing, polyadenlyation, addition of 5 '-cap), and translation.

As used herein, "transcription" or "transcribed" refers to the first of several steps of DNA based gene expression in which a target sequence of DNA is copied into RNA (especially mRNA) by the enzyme RNA polymerase. During transcription, a DNA sequence is read by an RNA polymerase, which produces a complementary, antiparallel RNA sequence called a primary transcript.

As used herein, "target sequence" means a sequence to which an oligomeric compound is intended to hybridize to result in a desired activity with respect to CFB expression. Oligonucleotides have sufficient complementarity to their target sequences to allow hybridization under physiological conditions.

As used herein, "nucleobase complementarity" or "complementarity" when in reference to nucleobases means a nucleobase that is capable of base pairing with another nucleobase. For example, in DNA, adenine (A) is complementary to thymine (T). For example, in RNA, adenine (A) is complementary to uracil (U). In both DNA and RNA, guanine (G) is complementary to cytosine (C). In certain embodiments, complementary nucleobase means a nucleobase of an oligomeric compound that is capable of base pairing with a nucleobase of its target sequence. For example, if a nucleobase at a certain position of an oligomeric compound is capable of hydrogen bonding with a nucleobase at a certain position of a target sequence, then the position of hydrogen bonding between the oligomeric compound and the target sequence is considered to be complementary at that nucleobase pair. Nucleobases comprising certain modifications may maintain the ability to pair with a counterpart nucleobase and thus, are still capable of nucleobase complementarity.

As used herein, "non-complementary" in reference to nucleobases means a pair of nucleobases that do not form hydrogen bonds with one another.

As used herein, "complementary" in reference to oligomeric compounds (e.g., linked nucleosides, oligonucleotides) means the capacity of such oligomeric compounds or regions thereof to hybridize to a target sequence, or to a region of the oligomeric compound itself, through nucleobase complementarity.

Complementary oligomeric compounds need not have nucleobase complementarity at each nucleoside. Rather, some mismatches are tolerated. In certain embodiments, complementary oligomeric compounds or regions are complementary at 70% of the nucleobases (70% complementary). In certain embodiments, complementary oligomeric compounds or regions are 80%>complementary. In certain embodiments, complementary oligomeric compounds or regions are 90%>complementary. In certain embodiments, complementary oligomeric compounds or regions are at least 95% complementary. In certain embodiments, complementary oligomeric compounds or regions are 100% complementary.

As used herein, "self-complementarity" in reference to oligomeric compounds means a compound that may fold back on itself, creating a duplex as a result of nucleobase hybridization of internal complementary strand regions. Depending on how close together and/or how long the strand regions are, then the compound may form hairpin loops, junctions, bulges or internal loops.

As used herein, "mismatch" means a nucleobase of an oligomeric compound that is not capable of pairing with a nucleobase at a corresponding position of a target sequence, or at a corresponding position of the oligomeric compound itself when the oligomeric compound hybridizes as a result of self-complementarity, when the oligomeric compound and the target sequence and/or self-complementary regions of the oligomeric compound, are aligned.

As used herein, "hybridization" means the pairing of complementary oligomeric compounds (e.g., an oligomeric compound and its target sequence). While not limited to a particular mechanism, the most common mechanism of pairing involves hydrogen bonding, which may be Watson-Crick, Hoogsteen or reversed Hoogsteen hydrogen bonding, between complementary nucleobases.

As used herein, "specifically hybridizes" means the ability of an oligomeric compound to hybridize to one nucleic acid site with greater affinity than it hybridizes to another nucleic acid site.

As used herein, "fully complementary" in reference to an oligomeric compound or region thereof means that each nucleobase of the oligomeric compound or region thereof is capable of pairing with a nucleobase of a complementary nucleic acid target sequence or a self-complementary region of the oligomeric compound. Thus, a fully complementary oligomeric compound or region thereof comprises no mismatches or unhybridized nucleobases with respect to its target sequence or a self-complementary region of the oligomeric compound.

As used herein, "percent complementarity" means the percentage of nucleobases of an oligomeric compound that are complementary to an equal-length portion of a target nucleic acid. Percent complementarity is calculated by dividing the number of nucleobases of the oligomeric compound that are complementary to nucleobases at corresponding positions in the target nucleic acid by the total length of the oligomeric compound.

As used herein, "percent identity" means the number of nucleobases in a first nucleic acid that are the same type (independent of chemical modification) as nucleobases at corresponding positions in a second nucleic acid, divided by the total number of nucleobases in the first nucleic acid.

As used herein, "modulation" means a change of amount or quality of a molecule, function, or activity when compared to the amount or quality of a molecule, function, or activity prior to modulation. For example, modulation includes the change, either an increase (stimulation or induction) or a decrease (inhibition or reduction) in gene expression.

As used herein, "type of modification" in reference to a nucleoside or a nucleoside of a "type" means the chemical modification of a nucleoside and includes modified and unmodified nucleosides. Accordingly, unless otherwise indicated, a "nucleoside having a modification of a first type" may be an unmodified nucleoside.

As used herein, "differently modified" mean chemical modifications or chemical substituents that are different from one another, including absence of modifications. Thus, for example, a MOE nucleoside and an unmodified naturally occurring RNA nucleoside are "differently modified," even though the naturally occurring nucleoside is unmodified. Likewise, DNA and RNA oligonucleotides are "differently modified," even though both are naturally-occurring unmodified nucleosides. Nucleosides that are the same but for comprising different nucleobases are not differently modified. For example, a nucleoside comprising a 2'-OMe modified sugar moiety and an unmodified adenine nucleobase and a nucleoside comprising a 2'-OMe modified sugar moiety and an unmodified thymine nucleobase are not differently modified.

As used herein, "the same type of modifications" refers to modifications that are the same as one another, including absence of modifications. Thus, for example, two unmodified RNA nucleosides have "the same type of modification," even though the RNA nucleosides are unmodified. Such nucleosides having the same type modification may comprise different nucleobases.

As used herein, "region" or "regions", or "portion" or "portions", mean a plurality of linked nucleosides that have a function or character as defined herein, in particular with reference to the claims and definitions as provided herein. Typically such regions or portions comprise at least 10, at least 11, at least 12 or at least 13 linked nucleosides. For example, such regions can comprise 13 to 20 linked nucleosides, such as 13 to 16 or 18 to 20 linked nucleosides. Typically a first region as defined herein consists essentially of 18 to 20 nucleosides and a second region as defined herein consists essentially of 13 to 16 linked nucleosides.

As used herein, "pharmaceutically acceptable carrier or diluent" means any substance suitable for use in administering to an animal. In certain embodiments, a pharmaceutically acceptable carrier or diluent is sterile saline. In certain embodiments, such sterile saline is pharmaceutical grade saline.

As used herein, "substituent" and "substituent group," means an atom or group that replaces the atom or group of a named parent compound. For example a substituent of a modified nucleoside is any atom or group that differs from the atom or group found in a naturally occurring nucleoside (e.g., a modified 2'-substituent is any atom or group at the 2 '-position of a nucleoside other than H or OH). Substituent groups can be protected or unprotected. In certain embodiments, compounds of the present disclosure have substituents at one or at more than one position of the parent compound. Substituents may also be further substituted with other substituent groups and may be attached directly or via a linking group such as oxygen or an alkyl or hydrocarbyl group to a parent compound.

Such substituents can be present as the modification on the sugar moiety, in particular a substituent present at the 2'-position of the sugar moiety. Unless otherwise indicated, groups amenable for use as substituents include without limitation, one or more of halo, hydroxyl, alkyl, alkenyl, alkynyl, acyl, carboxyl, alkoxy, alkoxyalkylene and amino substituents. Certain substituents as described herein can represent modifications directly attached to a ring of a sugar moiety (such as a halo, such as fluoro, directly attached to a sugar ring), or a modification indirectly linked to a ring of a sugar moiety by way of an oxygen linking atom that itself is directly linked to the sugar moiety (such as an alkoxyalkylene, such as methoxyethylene, linked to an oxygen atom, overall providing an MOE substituent as described herein attached to the 2'-position of the sugar moiety).

As used herein, "alkyl," as used herein, means a saturated straight or branched monovalent C1-6 hydrocarbon radical. Methyl is advantageously the alkyl employed as a substituent at the 2'-position of the sugar moiety. The alkyl group typically attaches to an oxygen linking atom at the 2'position of the sugar, therefore, overall providing a —Oalkyl substituent, such as an $—OCH_3$ substituent, on a sugar moiety of an oligomeric compound as described herein. This will be well understood be a person skilled in the art.

As used herein, "alkylene" means a saturated straight or branched divalent hydrocarbon radical of the general formula $—C_nH_{2n}—$ where n is 1-6. Methylene or ethylene are advantageous alkylenes.

As used herein, "alkenyl" means a straight or branched unsaturated monovalent C2-6 hydrocarbon radical, with ethenyl or propenyl being specific alkenyls as a substituent at the 2'-position of the sugar moiety. As will be well understood in the art, the degree of unsaturation that is present in an alkenyl radical is the presence of at least one carbon to carbon double bond. The alkenyl group typically attaches to an oxygen linking atom at the 2'-position of the sugar, therefore, overall providing a —Oalkenyl substituent, such as an $—OCH_2CH{=}CH_2$ substituent, on a sugar moiety of an oligomeric compound as described herein. This will be well understood be a person skilled in the art.

As used herein, "alkynyl" means a straight or branched unsaturated C2-6 hydrocarbon radical, with ethynyl being an example of a substituent at the 2'-position of the sugar moiety. As will be well understood in the art, the degree of unsaturation that is present in an alkynyl radical is the presence of at least one carbon to carbon triple bond. The alkynyl group typically attaches to an oxygen linking atom at the 2'-position of the sugar, therefore, overall providing a —Oalkynyl substituent on a sugar moiety of an oligomeric compound as described herein. This will be well understood be a person skilled in the art.

As used herein, "carboxyl" is a radical having a general formula $—CO_2H$.

As used herein, "acyl" means a radical formed by removal of a hydroxyl group from a carboxyl radical as defined herein and has the general Formula —C(O)—X where X is typically $C_{1-6}$ alkyl.

As used herein, "alkoxy" means a radical formed between an alkyl group, such as a $C_{1-6}$ alkyl group, and an oxygen atom where the oxygen atom is used to attach the alkoxy group either to a parent molecule (such as at the 2'-position of a sugar moiety), or to another group such as an alkylene group as defined herein. Examples of alkoxy groups include without limitation, methoxy, ethoxy, propoxy, isopropoxy, n-butoxy, sec-butoxy and tert-butoxy. Alkoxy groups as used herein may optionally include further substituent groups.

As used herein, alkoxyalkylene means an alkoxy group as defined herein that is attached to an alkylene group also as defined herein, and where the oxygen atom of the alkoxy group attaches to the alkylene group and the alkylene attaches to a parent molecule. The alkylene group typically attaches to an oxygen linking atom at the 2'-position of the sugar, therefore, overall providing a —Oalkylenealkoxy substituent, such as an $—OCH_2CH_2OCH_3$ substituent, on a sugar moiety of an oligomeric compound as described herein. This will be well understood by a person skilled in the art and is generally referred to as an MOE substituent as defined herein and as known in the art.

As used herein, "amino" includes primary, secondary and tertiary amino groups.

As used herein, "halo" and "halogen," mean an atom selected from fluorine, chlorine, bromine and iodine.

As used herein, the term "mxRNA" is in particular understood as defined in WO 2020/044186 A2 which is incorporated by reference herein in its entirety.

As used herein, the term "factor Bb" denotes the corresponding and commonly known protein which binds to C3b within the C3 convertase within complement activation. Factor Bb is an active subunit of CFB and can be produced by a cleavage of CFB into factors Ba and Bb due to factor D, for example in the alternative pathway of the complement activation, after CFB is bound to C3b. The factor Bb level can, such as in the examples provided below, be used as an indicator for the success of a silencing of CFB expression.

It will also be understood that oligomeric compounds as described herein may have one or more non-hybridizing nucleosides at one or both ends of one or both strands (overhangs) and/or one or more internal non-hybridizing nucleosides (mismatches) provided there is sufficient complementarity to maintain hybridization under physiologically relevant conditions. Alternatively, oligomeric compounds as described herein may be blunt ended at at least one end.

The term "comprising" is used herein to mean including the method steps or elements identified, but that such steps or elements do not comprise an exclusive list and as such there may be present additional steps or elements.

Further, to the extent that the term "includes" is used in either the detailed description or the claims, such term is intended to be inclusive in a manner similar to the term "comprising" as "comprising" is interpreted when employed as a transitional word in a claim.

The following non-limiting embodiments (items) are provided:

1. An oligomeric compound capable of inhibiting expression of complement factor B (CFB), where the compound comprises at least a first region of linked nucleosides having at least a first nucleobase sequence that is at least partially complementary to at least a portion of RNA transcribed from an CFB gene, where the first nucleobase sequence is selected from the following sequences, or a portion thereof: sequences of Table 1a (SEQ ID NOs: 1 to 250, 751 and 752), where the portion advantageously has a length of at least 18 nucleotides.

The first region is also referred to as antisense region or guide region, and the second region is also referred to as sense region or passenger region. As disclosed in specific embodiments below, the two regions may be located on the same strand, advantageously in an adjacent manner. This gives rise to hairpin molecules, also referred to as mxRNAs. On the other hand, the two regions may be located on separate strands which gives rise to double-stranded RNAs (dsRNAs), where advantageously each strand consists of the respective region.

Moreover, the regions may serve as building blocks for muRNAs (see above). In other words, the first and the second region as defined herein may be used, in accordance with the following definition of muRNAs, as first and third regions, respectively:

A nucleic acid construct (muRNA) comprising at least:

(a) a first nucleic acid portion that is at least partially complementary to at least a first portion of an RNA which is transcribed from a CFB gene;

(b) a second nucleic acid portion that is at least partially complementary to at least a second portion of an RNA which is transcribed from another gene;

(c) a third nucleic acid portion that is at least partially complementary to the first nucleic acid portion of (a), so as to form a first nucleic acid duplex region therewith;

(d) a fourth nucleic acid portion that is at least partially complementary to the second nucleic acid portion of (b), so as to form a second nucleic acid duplex region therewith.

Specific embodiments of and further aspects relating to muRNAs are disclosed in WO 2020/065602.

Specific nucleobase sequences are those of SEQ ID NOs: 751 and 752.

2. The oligomeric compound according to item 1, which further comprises at least a second region of linked nucleosides having at least a second nucleobase sequence that is at least partially complementary to the first nucleobase sequence and is selected from the following sequences, or a portion thereof: sequences of Table 1b (SEQ ID NOs: 251 to 500, 753 and 754), where the portion advantageously has a length of at least 8, 9, 10 or 11 nucleotides.

Specific nucleobase sequences are those of SEQ ID NOs: 753 and 754.

3. The oligomeric compound according to item 1 or 2, where the first nucleobase sequence is selected from the following sequences, or a portion thereof: SEQ ID NOs: 94, 247, 13, 106, 28, 135, 132, 32, 83, 102, 62, 241, 9, 54, 143, 103, 128, 53, 150, 82, 36, 25, 71, 17, 5, 141, 90, 127, 75, 95, 751, and 752.

4. The oligomeric compound according to item 3, where the second nucleobase sequence is selected from the following sequences, or a portion thereof: SEQ ID NOs: 344, 497, 263, 356, 278, 385, 382, 282, 333, 352, 312, 491, 259, 304, 393, 353, 378, 303, 400, 332, 286, 275, 321, 267, 255, 391, 340, 377, 325, 345, 753 and 754.

5. The oligomeric compound according to any of items 1 to 4, where the first nucleobase sequence is selected from the following sequences, or a portion thereof: SEQ ID NOs: 13, 53, 62, 83, 102, 106, 135, 751, and 752.

6. The oligomeric compound according to item 5, where the second nucleobase sequence is selected from the following sequences, or a portion thereof: SEQ ID NOs: 263, 303, 312, 333, 352, 356, 385, 753 and 754.

7. The oligomeric compound according to any of items 1 to 6, where the first region of linked nucleosides consists essentially of 18 to 35, 18 to 20, 18 or 19, or 19 linked nucleosides.

8. The oligomeric compound according to any of items 2 to 7, where the second region of linked nucleosides consists essentially of 10 to 35, 10 to 20, 10 to 16, or 10 to 15 linked nucleosides, such as 11, 12, 13 or 14 linked nucleosides, 14 being especially advantageous.

9. The oligomeric compound according to any of items 2 to 8, which comprises at least one complementary duplex region that comprises at least a portion of the first nucleoside region directly or indirectly linked to at least a portion of the second nucleoside region, where advantageously the duplex region has a length of 10 to 19, 12 to 19, 12 to 15 base pairs, 13 or 14 base pairs, or 14 base pairs, where optionally there is one mismatch within the duplex region.

10. The oligomeric compound according to item 9, where each of the first and second nucleoside regions has a 5' to 3' directionality thereby defining 5' and 3' regions respectively thereof.

11. The oligomeric compound according to item 10, where the 5' region of the first nucleoside region is directly or indirectly linked to the 3' region of the second nucleoside region, for example by complementary base pairing, where advantageously the 5' terminal nucleoside of the first nucleoside region base pairs with the 3' terminal nucleoside of the second nucleoside region.

12. The oligomeric compound according to item 11 or 13, where the 3' region of the first nucleoside region is directly or indirectly linked to the 5' region of the second nucleoside region, where advantageously the first nucleoside region is directly and covalently linked to the second nucleoside region such as by a phosphate, a phosphorothioate, or a phosphorodithoate. This amounts to the formation of a single oligonucleotide comprising or consisting of the two regions being directly fused to each other. Owing to the base pairing as defined in the previous embodiment, such oligonucleotide will assume a hairpin configuration. Optimized hairpins, especially in terms of size, are the subject of further embodiments below.

13. The oligomeric compound according to any of items 1 to 12, which further comprises one or more ligands.

14. The oligomeric compound according to item 13, where the one or more ligands are conjugated to the second nucleoside region and/or the first nucleoside region.

15. The oligomeric compound according to item 14, as dependent on item 10, where the one or more ligands are conjugated at the 3' region, advantageously to the 3' end of the second nucleoside region and/or of the first nucleoside region, and/or to the 5' end of the second nucleoside region.

16. The oligomeric compound according to any of items 13 to 15, where the one or more ligands are any cell directing moiety, such as lipids, carbohydrates, aptamers, vitamins and/or peptides that bind cellular membrane or a specific target on cellular surface.

17. The oligomeric compound according to item 16, where the one or more ligands comprise one or more carbohydrates.

18. The oligomeric compound according to item 17, where the one or more carbohydrates can be a monosaccharide, disaccharide, trisaccharide, tetrasaccharide, oligosaccharide or polysaccharide.

19. The oligomeric compound according to item 18, where the one or more carbohydrates comprise or consist of one or more hexose moieties.

20. The oligomeric compound according to item 19, where the one or more hexose moieties are one or more galactose moieties, one or more lactose moieties, one or more N-Acetyl-Galactosamine moieties, and/or one or more mannose moieties.

21. The oligomeric compound according to item 20, where the one or more carbohydrates comprise one or more N-Acetyl-Galactosamine moieties.

22. The oligomeric compound according to item 21, which comprises two or three N-Acetyl-Galactosamine moieties, advantageously three.

23. The oligomeric compound according to any of items 13 to 22, where the one or more ligands are attached to the oligomeric compound, advantageously to the second nucleoside region thereof, in a linear configuration, or in a branched configuration.

A specific ligand is the following, also referred to as "toothbrush":

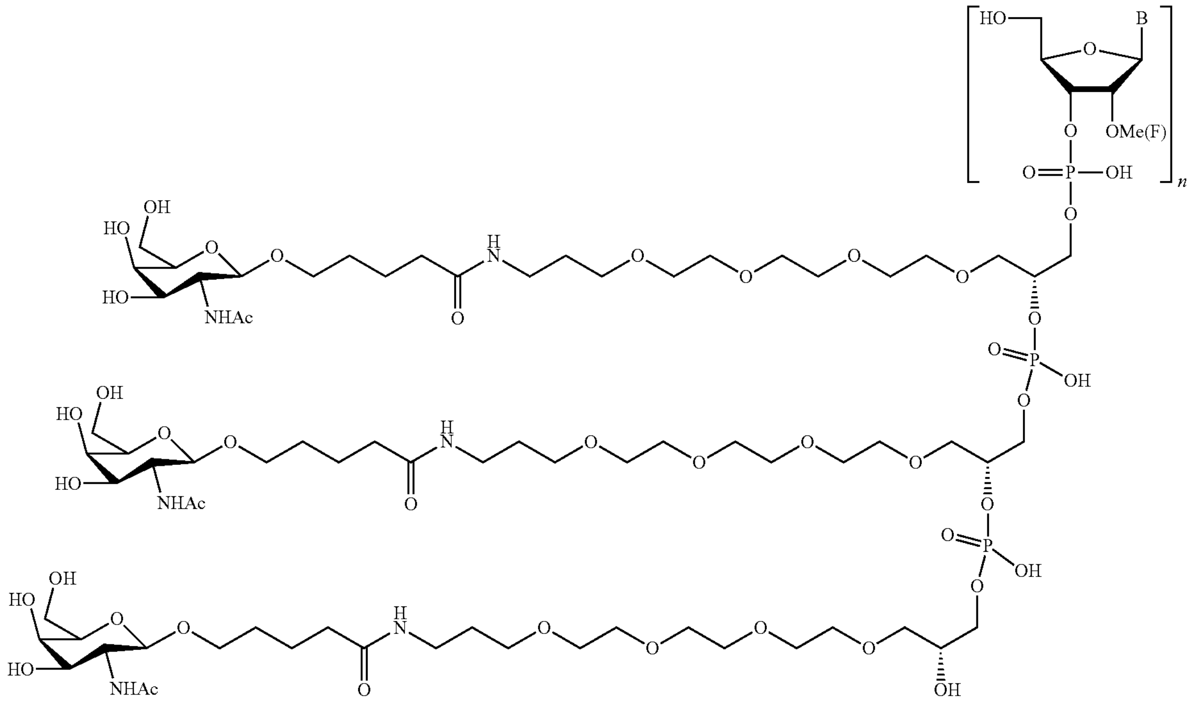

24. The oligomeric compound according to item 23, where the one or more ligands are attached to the oligomeric compound as a biantennary or triantennary configuration.

25. The oligomeric compound according to any one of item 1 to 24, where the compound consists of the first region of linked nucleosides and the second region of linked nucleosides. Each of the regions may constitute a separate strand, thereby giving rise to a double-stranded RNA (dsRNA). Particularly advantageous dsRNAs are those with a length of the first strand of 19 nucleosides and a length of the second region of 14 or 15, advantageously 14 nucleosides. When used for defining the length of a region or strand, the terms "nucleoside" and "nucleotide" (sometimes abbreviated "nt") are used equivalently.

In the alternative, and as stated above, the two regions may be fused together, giving rise to a hairpin.

26. The oligomeric compound according to any one of items 1 to 24, where there is an intervening third region of linked nucleosides between the first and the second region.

27. The oligomeric compound according to item 26, where the oligomeric compound comprises or consists of a single strand comprising or consisting of the first, the third, and the second nucleoside regions, where the single strand dimerises whereby at least a portion of the first nucleoside region is directly or indirectly linked to at least a portion of the second nucleoside region so as to form the at least partially complementary duplex region. In other words, the oligomeric compound comprises a single strand comprising the first and second nucleoside regions, where at least a portion of the first nucleoside region is directly or indirectly linked to at least a portion of the second nucleoside region so as to form the at least partially complementary duplex region. As noted above, the third region is optional.

28. The oligomeric compound according to any one of item 9 to 25, where the oligomeric compound comprises or consists of a single strand comprising or consisting of the first and second nucleoside regions, where the single strand dimerises whereby at least a portion of the first nucleoside region is directly or indirectly linked to at least a portion of the second nucleoside region so as to form the at least partially complementary duplex region.

29. The oligomeric compound according to item 28, where the first and the second nucleoside regions are directly adjacent on the single strand.

30. The oligomeric compound according to item 28 or 29, where the first nucleoside region has a greater number of linked nucleosides compared to the second nucleoside region.

31. The oligomeric compound of item 29, whereby the additional number of linked nucleosides of the first nucleoside region form a hairpin loop linking the first and second nucleoside regions.

Such compounds are also referred to as hairpins or mxRNAs herein. Owing to the second region being shorter as compared to the first region, the compound is optimized in terms of size (or miniaturized) as compared to a conventional siRNA which has two regions of comparable length.

Advantageously, the loop has 4 or 5 linked nucleosides. Particularly advantageous is a length of the first region of 19 nucleosides, of the second region of 14 nucleotides, and of the hairpin loop of 5 nucleotides, where the 5 nucleotides in the hairpin are the 5 3'-terminal nucleosides of the first region. Such a molecular architecture of a hairpin or mxRNA is also designated "14-5-14" herein.

32. The oligomeric compound according to any one of items 27 to 31, where the single strand has a nucleobase sequence selected from SEQ ID NOs: 751 and 752 and, where advantageously the strand has an additional nucleobase sequence selected from SEQ ID Nos: 753 and 754.

33. The oligomeric compound according to item 32, where the single strand is selected from Table 3, in particular from sequence "13(5) a+s" and "106-13(4) as +s", or from Table 4.

34. The oligomeric compound according to item 31, as dependent on item 10, whereby the hairpin loop is present at the 3' region of the first nucleoside region, where optionally one, two or more 3' terminal nucleotides, to the extent the nucleobases of the one, two or more 3' terminal nucleotides permit, fold back and form or contribute to the second nucleoside region.

This is a structural design also referred to as "spill-over". It is only possible in those cases where there is self-complementarity between the nucleobases at the 3'-terminal end of the region of the guide sequence comprised in the duplex and the very 3'-terminal nucleobases of the same guide sequence. For example, this could implemented as a 13-5-13 design, thereby allowing for further miniaturization. The first "13" refers to the region of the guide sequence involved in the duplex, 5 is the length of the loop which is also formed by the guide sequence, and the second 13 refers to the second region of the duplex and is formed by one nucleobase of the guide sequence and 12 nucleobases of the passenger region in 5' to 3' direction. As such, a length of the guide sequence of 19 nucleotides is maintained, but the passenger sequence is shortened to 12 nucleotides.

A further example is a 13-4-13 design which is implemented by construct 106-13(4) as discussed in more detail below.

35. The oligomeric compound of item 26 or 27, where the third nucleoside region and optionally a 3'-terminal portion, advantageously consisting of 1, 2, 3, 4, 5, 6, 7, 8, 9, or 10 linked nucleosides, of the first nucleoside region and/or a 5'-terminal portion, advantageously consisting of 1, 2, 3, 4, 5, 6, 7, 8, 9, or 10 linked nucleosides, of the second nucleoside region form a hairpin loop.

36. The oligomeric compound according to any one of items 29 to 31, where the hairpin loop comprises 4 to 10, advantageously 4 or 5 linked nucleosides.

37. The oligomeric compound according to any one of items 29 to 34, where the oligomeric compound has or comprises the nucleobase sequence of any one of the sequences shown in Table 2 (SEQ ID NOs: 501 to 750, 755 or 756).

38. The oligomeric compound according to any of items 1 to 37, which comprises internucleoside linkages and where at least one internucleoside linkage is a modified internucleoside linkage.

39. The oligomeric compound according to item 38, where the modified internucleoside linkage is a phosphorothioate or phosphorodithioate internucleoside linkage.

Specific modified internucleoside linkages are the subject of the specific embodiments which follow. Certain modified internucleoside linkages are known in the art and described in, for example, Hu et al., Signal Transduction and Targeted Therapy (2020)5:101.

40. The oligomeric compound according to item 39, which comprises 1 to 15 phosphorothioate or phosphorodithioate internucleoside linkages.

41. The oligomeric compound according to item 40, which comprises 7, 8, 9 or 10 phosphorothioate or phosphorodithioate internucleoside linkages.

42. The oligomeric compound according to any of items 39 to 41, as dependent on item 10, which comprises one or more phosphorothioate or phosphorodithioate internucleoside linkages at the 5' region of the first nucleoside region.

43. The oligomeric compound according to any of items 39 to 42, as dependent on item 10, which comprises one or more phosphorothioate or phosphorodithioate internucleoside linkages at the 5' region of the second nucleoside region.

44. The oligomeric compound according to any of items 39 to 43, as dependent on any one of items 31 to 33, which comprises phosphorothioate or phosphorodithioate internucleoside linkages between at least two, at least three, at least four, at least five, adjacent nucleosides of the hairpin loop, dependent on the number of nucleotides present in the hairpin loop.

45. The oligomeric compound according to item 44, which comprises a phosphorothioate or phosphorodithioate internucleoside linkage between each adjacent nucleoside that is present in the hairpin loop.

46. The oligomeric compound according to any of items 1 to 45, where at least one nucleoside comprises a modified sugar.

Specific modified sugars are subject of the specific embodiments which follow. Certain modified sugars are known in the art and described in, for example, Hu et al., Signal Transduction and Targeted Therapy (2020)5:101.

47. The oligomeric compound according to item 46, where the modified sugar is selected from 2' modified sugars, a conformationally restricted nucleotide (CRN) sugar such as locked nucleic acid (LNA) sugar, (S)-constrained ethyl bicyclic nucleic acid, and constrained ethyl (cEt) sugar, tricyclo-DNA, morpholino, unlocked nucleic acid (UNA) sugar, glycol nucleic acid (GNA), D-hexitol nucleic acid (HNA), and cyclohexene nucleic acid (CeNA).

48. The oligomeric compound according to item 47, where the 2' modified sugar is selected from 2'-O-alkyl modified sugar, 2'-O-methyl modified sugar, 2'-O-methoxyethyl modified sugar, 2'-O-allyl modified sugar, 2'-C-allyl modified sugar, 2'-deoxy modified sugar such as 2'-deoxy ribose, 2'-F modified sugar, 2'-arabino-fluoro modified sugar, 2'-O-benzyl modified sugar, and 2'-O-methyl-4-pyridine modified sugar.

49. The oligomeric compound according to item 48, where at least one modified sugar is a 2'-O-methyl modified sugar.

50. The oligomeric compound according to item 48 or 49, where at least one modified sugar is a 2'-F modified sugar and, optionally, at most 5 sugars are 2'-F modified sugars.

51. The oligomeric compound of item 49 or 50, where the sugar is ribose.

52. The oligomeric compound according to any of items 49 to 51, as dependent on item 10, where sugars of the nucleosides at any of positions 2 and 14 downstream from the first nucleoside of the 5' region of the first nucleoside region, do not contain 2'-O-methyl modifications.

53. The oligomeric compound according to any of items 49 to 52, as dependent on item 10, where sugars of the nucleosides of the second nucleoside region, that correspond in position to any of the nucleosides of the first nucleoside region at any of positions 9 to 11 downstream from the first nucleotide of the 5' region of the first nucleoside region, do not contain 2'-O-methyl modifications. Positions 9 to 11 may contain 2, 1 or 0 2'-O-methyl substitutions.

54. The oligomeric compound of any one of items 49 to 53, where the 3' terminal position of the second nucleoside region does not contain a 2'-O-methyl modification.

55. The oligomeric compound according to item 53 or 54, where sugars of the nucleosides at any of positions 2 and 14 downstream from the first nucleoside of the 5' region of the first nucleoside region, contain 2'-F modifications.

56. The oligomeric compound according to any of items 53 to 55, where sugars of the nucleosides of the second nucleoside region, that correspond in position to any of the nucleosides of the first nucleoside region at any of positions 9 to 11 downstream from the first nucleoside of the 5' region of the first nucleoside region, contain 2'-F modifications.

57. The oligomeric compound of item 55 or 56, where the 3' terminal position of the second nucleoside region contains a 2'-F modification.

58. The oligomeric compound according to any of items 53 to 57, as dependent on item 10, where one or more of the odd numbered nucleosides starting from the 5' region of the first nucleoside region are modified, and/or where one or more of the even numbered nucleotides starting from the 5' region of the first nucleoside region are modified, where typically the modification of the even numbered nucleotides is a second modification that is different from the modification of odd numbered nucleotides.

59. The oligomeric compound according to item 58, where one or more of the odd numbered nucleosides starting from the 3' region of the second nucleoside region are modified by a modification that is different from the modification of odd numbered nucleosides of the first nucleoside region.

60. The oligomeric compound according to item 58 or 59, where one or more of the even numbered nucleosides starting from the 3' region of the second nucleoside region are modified by a modification that is different from the modification of even numbered nucleosides of the first nucleoside region according to item 52.

61. The oligomeric compound according to any of items 58 to 60, where at least one or more of the modified even numbered nucleosides of the first nucleoside region is adjacent to at least one or more of the differently modified odd numbered nucleosides of the first nucleoside region.

62. The oligomeric compound according to any of items 58 to 61, where at least one or more of the modified even numbered nucleosides of the second nucleoside region is adjacent to at least one or more of the differently modified odd numbered nucleosides of the second nucleoside region.

63. The oligomeric compound according to any of items 58 to 62, where sugars of one or more of the odd numbered nucleosides starting from the 5' region of the first nucleoside region are 2'-O-methyl modified sugars.

64. The oligomeric compound according to any of items 58 to 63, where one or more of the even numbered nucleosides starting from the 5' region of the first nucleoside region are 2'-F modified sugars.

65. The oligomeric compound according to any of items 58 to 64, where sugars of one or more of the odd numbered nucleosides starting from the 3' region of the second nucleoside region are 2'-F modified sugars.

66. The oligomeric compound according to any of items 58 to 65, where one or more of the even numbered nucleosides starting from the 3' region of the second nucleoside region are 2'-O-methyl modified sugars.

67. The oligomeric compound according to any of items 46 to 66, where sugars of a plurality of adjacent nucleosides of the first nucleoside region are modified by a common modification.

68. The oligomeric compound according to any of items 46 to 67, where sugars of a plurality of adjacent nucleosides of the second nucleoside region are modified by a common modification.

69. The oligomeric compound according to any of items 58 to 68, as dependent on any one of items 30 to 33, where sugars of a plurality of adjacent nucleosides of the hairpin loop are modified by a common modification.

70. The oligomeric compound according to any of items 67 to 69, where the common modification is a 2'-F modified sugar.

71. The oligomeric compound according to any of items 67 to 69, where the common modification is a 2'-O-methyl modified sugar.

72. The oligomeric compound according to item 71, where the plurality of adjacent 2'-O-methyl modified sugars are present in at least eight adjacent nucleosides of the first and/or second nucleoside regions.

73. The oligomeric compound according to item 71, where the plurality of adjacent 2'-O-methyl modified sugars are present in three or four adjacent nucleosides of the hairpin loop.

74. The oligomeric compound according to item 46, as dependent on any one of items 30 to 33, where the hairpin loop comprises at least one nucleoside having a modified sugar.

75. The oligomeric compound according to item 74, where the at least one nucleoside is adjacent a nucleoside with a differently modified sugar.

76. The oligomeric compound according to item 75, where the modified sugar is a 2'-O-methyl modified sugar, and the differently modifies sugar is a 2'-F modified sugar.

77. The oligomeric compound according to any of items 1 to 76, which comprises one or more nucleosides having an un-modified sugar moiety.

78. The oligomeric compound according to item 77, where the unmodified sugar is present in the 5' region of the second nucleoside region.

79. The oligomeric compound according to item 77 or 78, as dependent on any one of items 31 to 36, where the unmodified sugar is present in the hairpin loop.

80. The oligomeric compound according to any of items 1 to 79, where one or more nucleosides of the first nucleoside region and/or the second nucleoside region is an inverted nucleoside and is attached to an adjacent nucleoside via the 3' carbon of its sugar and the 3' carbon of the sugar of the adjacent nucleoside, and/or one or more nucleosides of the first nucleoside region and/or the second nucleoside region is an inverted nucleoside and is attached to an adjacent nucleoside via the 5' carbon of its sugar and the 5' carbon of the sugar of the adjacent nucleoside.

81. The oligomeric compound according to any of items 1 to 80, which is blunt ended.

82. The oligomeric compound according to any of items 1 to 80, where either the first or second nucleoside region has an overhang.

83. The oligomeric compound according to any one of items 37 to 82, where the oligomeric compound is selected from the compounds set forth in Table 3.

84. A composition comprising an oligomeric compound according to any of items 1 to 80, and a physiologically acceptable excipient.

85. A pharmaceutical composition comprising an oligomeric compound according to any of items 1 to 83.

86. The pharmaceutical composition of item 85, further comprising a pharmaceutically acceptable excipient, diluent, antioxidant, and/or preservative.

87. The pharmaceutical composition of item 85 or 86, where the oligomeric compound is the only pharmaceutically active agent.

88. The pharmaceutical composition of item 85 or 86, where the pharmaceutical composition furthermore comprises one or more further pharmaceutically active agents.

89. The pharmaceutical composition of item 88, where the further pharmaceutically active agent(s) is/are (an) agent(s) which modulate(s) the innate and/or the adaptive immune system, for example a further oligomeric compound which is directed to an immune system target different from CFB, such as Interleukin-6; agents lowering the expression or level of Interleukin-6; or an agent such as an antibody targeting a complement component, such as Eculizumab.

90. The pharmaceutical composition of item 88 or 89, where the oligomeric compound and the further pharmaceutically active agent(s) are to be administered concomitantly or in any order.

91. An oligomeric compound according to any of items 1 to 83, for use in human or veterinary medicine or therapy.

92. An oligomeric compound according to any of items 1 to 83, for use in a method of treating, ameliorating and/or preventing a disease or disorder.

93. The compound for use of item 92, where the disease or disorder is a complement component-associated disease or disorder or a disease or disorder requiring reduction of CFB expression levels.

94. The compound for use of item 93, where the disease or disorder is selected from autoimmune disease, complement system dysfunction including aberrant upregulation of complement components such as CFB, age-related macular degeneration (AMD) including dry AMD and geographic atrophy, paroxysmal nocturnal hemoglobinuria (PNH), atypical hemolytic uremic syndrome (aHUS), C3 glomerulopathy (C3G), Ig-mediated kidney pathologies such as IgA nephropathy and primary membranous nephropathy, asthma, rheumatic disease, rheumatoid arthritis, systemic lupus erythematosus (SLE), anti-neutrophil cytoplasmic antibody (ANCA) vasculitis, antiphospholipid antibody syndrome (APS), glomerulonephritis, psoriasis, dermatomyositis bullous pemphigoid, Shiga toxin *E. coli*-related hemolytic uremic syndrome, myasthenia gravis (MG), neuromyelistis optica (NMO), dense deposit disease, C3 neuropathy, cold agglutinin disease, humoral and vascular transplant rejection, graft dysfunction, myocardial infarction, sensitization towards a transplant, and sepsis.

95. The compound for use of item 93 or 94, where the disease of disorder is selected from age-related macular degeneration (AMD) including dry AMD and geographic atrophy, paroxysmal nocturnal hemoglobinuria (PNH), atypical hemolytic uremic syndrome (aHUS), and C3 glomerulopathy (C3G).

96. A method of treating a disease or disorder comprising administration of an oligomeric compound according to any of items 1 to 83, to an individual in need of treatment.

97. The method according to item 96, where the oligomeric compound is administered subcutaneously or intravenously to the individual.

98. Use of an oligomeric compound according to any of items 1 to 83, for use in research as a gene function analysis tool.

99. Use of an oligomeric compound according to any of items 1 to 83 in the manufacture of a medicament for a treatment of a disease or disorder. The diseases and disorders may be the same as set forth under item 91 above.

Effects Achieved by the Oligomeric Compounds

The oligomeric compounds described herein cause a significant reduction of gene expression of complement factor B, e.g. in vitro, as e.g. shown in the examples disclosed herein. In addition, a significant reduction of the Bb levels in plasma, e.g. of non-human primates such as shown in the examples, can be achieved by using the oligomeric constructs as described herein indicating the success of RNAi in mammals. In particular, these effects can last over an extended time period, such as 13 weeks, e.g. in non-human primates. Particularly, CFB levels, as determined via its cleavage product Bb, can be reduced to a large extent, such as by up to 74% by using the inventive oligomeric constructs.

Furthermore, it was surprisingly found that, in certain embodiments, the mentioned effects are achieved by using oligomeric compounds as described herein in the form of shRNA constructs having a reduced length of e.g. 30 or 33 nucleosides compared to conventional shRNA molecules having greater lengths. This can e.g. make a synthesis of shRNA molecules more efficient, because less units are needed.

The aforementioned effects can be achieved by using a dosage of the inventive oligomeric compounds of about 1 mg/kg body weight to about 10 or more mg/kg body weight in mammals, in particular with respect to, but not limited thereto, non-human primates such as shown in the examples herein.

In particular, the aforementioned effects were obtained by one or more than one, e.g. three doses, using a dosage of about 1 to about 3 or more mg/kg body weight in mammals, in particular with respect to non-human primates such as shown in the examples herein.

It has also been surprisingly found that, in certain embodiments, the aforementioned beneficial effects can be achieved by using oligomeric compounds as described herein in the form of shRNA constructs having a reduced number of fluorine substitutions, such as five fluorine substitutions in total, on the respective 2' positions of their ribose units compared to conventional shRNA molecules.

For certain oligomeric compounds as described herein, being in the form of shRNA constructs, it was surprisingly found out that the aforementioned effects can be achieved by using short sense strands within the shRNA optionally having a length of 11 or 14 nucleosides which is shorter than the length of the sense strands in conventional shRNA molecules.

Constructs of the Inventive Oligomeric Compounds

The following Tables show nucleobase sequences of antisense and sense strands of oligomeric compounds as described herein as well as of nucleobase sequences of single-stranded oligomeric compounds, and definitions of modified oligomeric compounds (the notation includes nucleobase sequence, sugar modifications, and, where applicable, modified phosphates).

The notation used is common in the art and as the following meaning:

- A represents adenine;
- U represents uracil;
- C represents cytosine;
- G represents guanine.
- P represents a terminal phosphate group which is advantageous but not indispensable;
- m represents a methyl modification at the 2' position of the sugar of the underlying nucleoside;
- f represents a fluoro modification at the 2' position of the sugar of the underlying nucleoside.
- r indicates an unmodified (2'-OH) ribonucleotide;
- (ps) or #represents a phosphorothioate inter-nucleoside linkage;
- i represents an inverted inter-nucleoside linkage, which can be either 3'-3', or 5'-5';
- vp represents vinyl phosphonate;
- mvp represents methyl vinyl phosphonate;
- 3×GalNAc represents a trivalent GalNAc.

Notation Used for and Features of Specific Constructs

Furthermore when a notation like "13(5)" is used for describing the sequence of one of the inventive constructs, the number "13" designates the sequence based on the antisense sequence of SEQ ID NO:13, e.g. comprising a portion of 18 nucleotides thereof in accordance with the first aspect, suitable for RNAi with CFB, where the number in the round brackets, i.e. 5 in the present case, designates the number of nucleosides present in the hairpin loop of the shRNA. In the particular case of 13(5), the 5'-terminal A of SEQ ID NO: 13 has been replaced with a U. Construct 13(5) implements a 14-5-14 design.

In case of "106-13(4)", the first number (106) again indicates that the construct is derived from the guide sequence of SEQ ID NO: 106. The number 13 refers to a shortened duplex of 13 base pairs, and (4) refers to a loop region of 4 nucleotides. In other words, 106-13(4) is a molecules following a 13-4-13 design, with a guide sequence of 19 nucleotides, the 5'-terminal 13 nucleotides of which are involved in base pairing within a duplex region, the adjacent 4 nucleotides form the loop, and the two 3'-terminal nucleotides (positions 18 and 19 within the guide sequence) fold back and base pair with positions 13 and 12 of the guide sequence, respectively. Such spill-over (nucleotides of the guide sequence extending beyond the loop) allow for a further shortening of the passenger region which in this case has a length of 11 nucleotides only. The two 3'-terminal nucleotides of the guide region, together with the adjacent 11 nucleotides of the passenger region form a stretch of 13 contiguous nucleotides which base pair with the 5'-terminal 13 nucleotides of the guide region. As compared to construct 13(5), 106-13(4) is 3 nucleotides shorter, as a consequence of the spill-over and the loop being 4 instead of 5 nucleotides long.

Generally speaking, as used herein, "as" after the notation indicates that a sequence is an antisense sequence, whereas "s" indicates that the sequence is a sense sequence. Accordingly, an antisense strand linked to a sense strand is denoted "as +s".

Tables 1a and 1b below show nucleobase sequences of antisense and sense strands of 250 oligomeric compounds in accordance with the Examples. The numbering in Table 1a coincides with the number of the corresponding entry in the sequence listing. For Table 1b the following applies: entry number in the sequence listing=entry number in the Table+250, except for entries "13(5) as", referring to SEQ ID NO. 751 and "106-13(4) as", referring to SEQ ID NO. 752 (Table 1a); and except for entries "13(5) s", referring to SEQ ID NO. 753, and "106-13(4) s", referring to SEQ ID NO. 754.

TABLE 1a

Nucleobase sequences of the antisense strands of 252 constructs

| Experimental Label | 19 mer Antisense |
|---|---|
| CFB01 | UAGAAAACCCAAAUCCUCA |
| CFB02 | GCUGUCUGAUCCAUCUAGC |
| CFB03 | AACCAUGCCACAGAGACUC |
| CFB04 | GAUCCAUCUAGCACCAGGU |

TABLE 1a-continued

| Nucleobase sequences of the antisense strands of 252 constructs | |
|---|---|
| Experimental Label | 19 mer Antisense |
| CFB05 | AAAACCCAAAUCCUCAUCU |
| CFB06 | UCCAUCUAGCACCAGGUAG |
| CFB07 | GAAAACCCAAAUCCUCAUC |
| CFB08 | UGUCUGAUCCAUCUAGCAC |
| CFB09 | AACCCAAAUCCUCAUCUUG |
| CFB10 | AUCCAUCUAGCACCAGGUA |
| CFB11 | AAACCCAAAUCCUCAUCUU |
| CFB12 | CCAUGCCACAGAGACUCAG |
| CFB13 | AUGCCACAGAGACUCAGAG |
| CFB14 | GAUGAUGACAUGGCGGGUG |
| CFB15 | UUCCAUAUCCUUGACUUUG |
| CFB16 | UACACCAACUUGAAUGAAA |
| CFB17 | UGCCACAGAGACUCAGAGA |
| CFB18 | ACCAUGCCACAGAGACUCA |
| CFB19 | CCAUCUAGCACCAGGUAGA |
| CFB20 | UUUCCAUAUCCUUGACUUU |
| CFB21 | UGAUCCAUCUAGCACCAGG |
| CFB22 | GCCACAGAGACUCAGAGAC |
| CFB23 | CUGAUCCAUCUAGCACCAG |
| CFB24 | GACCUCCUUCCGAGUCAGC |
| CFB25 | GUCUGAUCCAUCUAGCACC |
| CFB26 | GUCUUGGCAGGAAGGCUCC |
| CFB27 | AUCUAGCACCAGGUAGAUG |
| CFB28 | AAAGUACUCAGACACCACA |
| CFB29 | CUGUCUGAUCCAUCUAGCA |
| CFB30 | CAUCUAGCACCAGGUAGAU |
| CFB31 | CCAAAUCCUCAUCUUGGAG |
| CFB32 | CAUAGUCAUAAAAUUCAGG |
| CFB33 | GAGGAUGAUGACAUGGCGG |
| CFB34 | ACAAUCUGUGUUCUGGCAC |
| CFB35 | UUGAGCUUGAUCAGGGCAA |
| CFB36 | CAGUGGAAAGAGAUCUCAU |
| CFB37 | UAGAUGUUCAUGGAGCCUG |
| CFB38 | GGCAAGUGGUAGUUGGAGG |
| CFB39 | UCACACCAUAACUUGCCAC |
| CFB40 | GAAAGAGAUCUCAUCACUC |
| CFB41 | UUCAACUUGUGGUCUUCAU |

TABLE 1a-continued

| Nucleobase sequences of the antisense strands of 252 constructs | |
|---|---|
| Experimental Label | 19 mer Antisense |
| CFB42 | GAAACGACUUCUCUUGUGA |
| CFB43 | GGUAUGUGGCAUAUGUCAC |
| CFB44 | UGUCUUUCUUGGAAGCCAA |
| CFB45 | ACAUCCAGAUAAUCCUCCC |
| CFB46 | CUUGACUUUGUCAUAGCCU |
| CFB47 | GAAACUCCAGACCUAGACC |
| CFB48 | CAUAACUUGCCACCUUCUC |
| CFB49 | UCAUAGUCAUAAAAUUCAG |
| CFB50 | UUGGCUCCUGUGAAGUUGC |
| CFB51 | CAAAGUACUCAGACACCAC |
| CFB52 | UGCUCAUUGUCUUUCUUGG |
| CFB53 | AUAAAAUUCAGGAAUUCCU |
| CFB54 | UGAGAUCUUGGCCUGCCAU |
| CFB55 | UGAGCAUCUCUCUCACAGC |
| CFB56 | UAACCGUCAUAGCAGUGGA |
| CFB57 | CAGAGCUUUGAUAUCCUGU |
| CFB58 | AACAAUGUGCUGCUGUCAG |
| CFB59 | GGGUACGGGUAGAAGCCAG |
| CFB60 | CCAGACCUAGACCUGGUCA |
| CFB61 | CUUCUCUUGUGAACUAUCA |
| CFB62 | AUUCAGGAAUUCCUGCUUC |
| CFB63 | UCCAGGUUUUCCAUAUCCU |
| CFB64 | CCAACUUGAAUGAAACGAC |
| CFB65 | UGUGCUGCUGUCAGCACAA |
| CFB66 | AGACCUCCUUCCGAGUCAG |
| CFB67 | UCAAUUAAGUUGACUAGAC |
| CFB68 | CUGACACGUUCGCCGCUGG |
| CFB69 | UCAUUGUCUUUCUUGGAAG |
| CFB70 | ACCAACUUGAAUGAAACGA |
| CFB71 | GCACAAAGUACUCAGACAC |
| CFB72 | CUGCAGUGGUAGGUGACGC |
| CFB73 | GUCAUGAGGAUGAUGACAU |
| CFB74 | CUUCAACUUGUGGUCUUCA |
| CFB75 | GGUAGUUGGAGGAAGCCUC |
| CFB76 | UCAUGCUGUACACUGCCUG |
| CFB77 | UUGUCUUUCUUGGAAGCCA |
| CFB78 | UCGACUCCUUCUAUGGUCU |

TABLE 1a-continued

Nucleobase sequences of the antisense strands of 252 constructs

| Experimental Label | 19 mer Antisense |
|---|---|
| CFB79 | AGACAUCCAGAUAAUCCUC |
| CFB80 | CUGAGAUCUUGGCCUGCCA |
| CFB81 | GACGCUGUCUUCAAGGCGG |
| CFB82 | AAGACAGGAAAGCUUCGGC |
| CFB83 | UUUGAACACAUGUUGCUCA |
| CFB84 | CAUAAAAUUCAGGAAUUCC |
| CFB85 | ACCCAAAUCCUCAUCUUGG |
| CFB86 | AAAGAGAUCUCAUCACUCA |
| CFB87 | CAAAGCAUUGAUGUUCACU |
| CFB88 | CAGGAAUUCCUGCUUCUUU |
| CFB89 | CAUGAAGGAGUCUUGGCAG |
| CFB90 | AAAGCUUCGGCCACCUCUU |
| CFB91 | UUGACUUUGUCAUAGCCUG |
| CFB92 | GUCCAAGCUGAAACUCCAG |
| CFB93 | CCCAAAUCCUCAUCUUGGA |
| CFB94 | GCAGCUGUUUUAAUUCAAU |
| CFB95 | AAACGACUUCUCUUGUGAA |
| CFB96 | CCCGGAACAUCCAAGCGGG |
| CFB97 | CCAAACACAUAGACAUCCA |
| CFB98 | CUUCACACCAUAACUUGCC |
| CFB99 | UUCUCUUGUGAACUAUCAA |
| CFB100 | AAUUCAGGAAUUCCUGCUU |
| CFB101 | AGACACUUUGACCCAAAUU |
| CFB102 | ACACAAACAGAGCUUUGAU |
| CFB103 | ACAAACAGAGCUUUGAUAU |
| CFB104 | CUUGGAGUUUCUCCUUCAG |
| CFB105 | UUCACACCAUAACUUGCCA |
| CFB106 | UUGAAUGAAACGACUUCUC |
| CFB107 | CCAGGUUUUCCAUAUCCUU |
| CFB108 | AGCAUCUCUCUCACAGCUG |
| CFB109 | GACAUCCAGAUAAUCCUCC |
| CFB110 | UCGAGUUGUUCCCUCGGUG |
| CFB111 | AACACAUGUUGCUCAUUGU |
| CFB112 | UUCUCAAUUAAGUUGACUA |
| CFB113 | GGAAGCCAAAGCAUUGAUG |
| CFB114 | AGCAGUGGAAAGAGAUCUC |
| CFB115 | UACACUGCCUGGAGGGCCU |

TABLE 1a-continued

Nucleobase sequences of the antisense strands of 252 constructs

| Experimental Label | 19 mer Antisense |
|---|---|
| CFB116 | CUAGACCUGGUCACAUUCC |
| CFB117 | UCAGACACAAACAGAGCUU |
| CFB118 | GGAGUUUCUCCUUCAGCCA |
| CFB119 | AAUGUGCUGCUGUCAGCAC |
| CFB120 | ACAGAGCUUUGAUAUCCUG |
| CFB121 | UGAUAUCCUGUGCAGGGAG |
| CFB122 | CAGGGCAACGUCAUAGUCA |
| CFB123 | CAGACCUAGACCUGGUCAC |
| CFB124 | AAGUACUCAGACACCACAG |
| CFB125 | GAAGGCUCCGUCCCGCUCC |
| CFB126 | AGGGCAACGUCAUAGUCAU |
| CFB127 | GCUGUUUUAAUUCAAUCCC |
| CFB128 | AAGAGAUCUCAUCACUCAC |
| CFB129 | UGGUCUUCAUAAUUGAUUU |
| CFB130 | CCAUAUCUUGGCUUCACAC |
| CFB131 | ACACCAACUUGAAUGAAAC |
| CFB132 | CAGCUGUUUUAAUUCAAUC |
| CFB133 | AUAACUUGCCACCUUCUCA |
| CFB134 | GUGAGCAGGUACCUGCUUU |
| CFB135 | CUUGAUGUAGACCUCCUUC |
| CFB136 | UGGCAAGUGGUAGUUGGAG |
| CFB137 | AGGAAGCCUCAAAGCUCGA |
| CFB138 | CAAUGACAGUAAUUGGGUC |
| CFB139 | CUUUGAACACAUGUUGCUC |
| CFB140 | CAAAUCCUCAUCUUGGAGU |
| CFB141 | UGGAGUUUCUCCUUCAGCC |
| CFB142 | CCAUAACUUGCCACCUUCU |
| CFB143 | AGCUGUUUUAAUUCAAUCC |
| CFB144 | AAAGCUCGAGUUGUUCCCU |
| CFB145 | GGGCAACGUCAUAGUCAUA |
| CFB146 | CUUCCAGGUUUUCCAUAUC |
| CFB147 | UUCCAGGUUUUCCAUAUCC |
| CFB148 | CCCAUGUUGUGCAAUCCAU |
| CFB149 | CCAUAUCCUUGACUUUGAA |
| CFB150 | UUGACUUUGAACACAUGUU |
| CFB151 | CCUCAUCUUGGAGUUUCUC |
| CFB152 | ACAUGUUGCUCAUUGUCUU |

TABLE 1a-continued

| Nucleobase sequences of the antisense strands of 252 constructs | |
|---|---|
| Experimental Label | 19 mer Antisense |
| CFB153 | CACCAACUUGAAUGAAACG |
| CFB154 | CACAGAUCGCUGUCUGCCC |
| CFB155 | CUCACAGCUGCCUUUCUUA |
| CFB156 | GGGCCGCCAGAAUCACCUC |
| CFB157 | UCCAAGCUGAAACUCCAGA |
| CFB158 | CUUGAUCAGGGCAACGUCA |
| CFB159 | UGUUCCCAAACCAUGCCAC |
| CFB160 | UACCUGCUUUUGCCGCUUC |
| CFB161 | GUUGCUCAUUGUCUUUCUU |
| CFB162 | ACACGUUCGCCGCUGGGAG |
| CFB163 | CCAUUCUUGAUGUAGACCU |
| CFB164 | CUUGAGCUUGAUCAGGGCA |
| CFB165 | CAUUCUUGAUGUAGACCUC |
| CFB166 | AUGAAGGAGUCUUGGCAGG |
| CFB167 | CUUGGCUUCACACCAUAAC |
| CFB168 | UAUCUUGGCUUCACACCAU |
| CFB169 | UCUCACAGCUGCCUUUCUU |
| CFB170 | CCCAAUGCUGUCUGAUCCA |
| CFB171 | GGAGUGGUGGUCACACCUC |
| CFB172 | CAUAGGGACUCACUCCUCC |
| CFB173 | CCUGACUUCAACUUGUGGU |
| CFB174 | CUUCUCAAUUAAGUUGACU |
| CFB175 | GAGUUUCUCCUUCAGCCAG |
| CFB176 | GAGCUUUGAUAUCCUGUGC |
| CFB177 | AUGUCCUUGACUUUGUCAU |
| CFB178 | GCAGGUACGUGUCUGCACA |
| CFB179 | GAAACAAUGUGCUGCUGUC |
| CFB180 | GAUAUCCUGUGCAGGGAGC |
| CFB181 | AGACUCAGAGACUGGCUUU |
| CFB182 | UCAAUGACAGUAAUUGGGU |
| CFB183 | AGAGCCACCUUCCUGACAC |
| CFB184 | CCUUGACUUUGAACACAUG |
| CFB185 | AAUGAAACGACUUCUCUUG |
| CFB186 | GGAAGACAGGAAAGCUUCG |
| CFB187 | AGCUUUGAUAUCCUGUGCA |
| CFB188 | UUCUUGAGCUUGAUCAGGG |
| CFB189 | UGGAUUGCUCUGCACUCUG |

TABLE 1a-continued

| Nucleobase sequences of the antisense strands of 252 constructs | |
|---|---|
| Experimental Label | 19 mer Antisense |
| CFB190 | GCAUAUUGAGCAUCUCUCU |
| CFB191 | UAUCCUUGACUUUGAACAC |
| CFB192 | UGCAGACAUCCACUACUCC |
| CFB193 | UAGACCUCCUUCCGAGUCA |
| CFB194 | CACCUUCUCAAUUAAGUUG |
| CFB195 | GAGAAGUCGGAAGGAGCCG |
| CFB196 | CUGCACAGGGUACGGGUAG |
| CFB197 | AAUGACAGUAAUUGGGUCC |
| CFB198 | UGUUAGUCCCUGACUUCAA |
| CFB199 | CAUAUCCUUGACUUUGAAC |
| CFB200 | GGUACGUGUCUGCACAGGG |
| CFB201 | UGUCAGCACAAAGUACUCA |
| CFB202 | GUGGUCUUCAUAAUUGAUU |
| CFB203 | ACAGAGACUCAGAGACUGG |
| CFB204 | AUAGACAUCCAGAUAAUCC |
| CFB205 | CCUCCUUCCGAGUCAGCUU |
| CFB206 | UCAUGGAGCCUGAAGGGUC |
| CFB207 | GUGGCAUAUGUCACUAGAC |
| CFB208 | AAAGCAUUGAUGUUCACUU |
| CFB209 | ACUCACUCCUCCAGUACAA |
| CFB210 | AGAUGUCCUUGACUUUGUC |
| CFB211 | CUGUUUUAAUUCAAUCCCA |
| CFB212 | GUAGAUGUUCAUGGAGCCU |
| CFB213 | CAUAGCAGUGGAAAGAGAU |
| CFB214 | CCAUUCACUUGGCAGGUGC |
| CFB215 | CAUUGAUGUUCACUUGGUU |
| CFB216 | UCAGCCAGGGCAGCACUUG |
| CFB217 | GCUCAGUGUCCAAGCUGAA |
| CFB218 | UCAGAGACUGGCUUUCAUC |
| CFB219 | CAUCCAGAUAAUCCUCCCU |
| CFB220 | CCUUCUCAAUUAAGUUGAC |
| CFB221 | UCCAGACCUAGACCUGGUC |
| CFB222 | GCAACGUCAUAGUCAUAAA |
| CFB223 | CUUGAAUGAAACGACUUCU |
| CFB224 | UCCUCCUCAGACACAAACA |
| CFB225 | GAAGCCAAAGCAUUGAUGU |
| CFB226 | AUGAAACGACUUCUCUUGU |

TABLE 1a-continued

| Nucleobase sequences of the antisense strands of 252 constructs | |
|---|---|
| Experimental Label | 19 mer Antisense |
| CFB227 | CAACUUGUGGUCUUCAUAA |
| CFB228 | ACCAGGUAGAUGUUCAUGG |
| CFB229 | UCUGUGUUCUGGCACCUGC |
| CFB230 | UAACUUGCCACCUUCUCAA |
| CFB231 | UGCCAUGGUUGCUUGUGGU |
| CFB232 | AGACAAAUGGGCCUGAUAG |
| CFB233 | UAAGUUGACUAGACACUUU |
| CFB234 | ACAUGGCGGGUGCGGUUCC |
| CFB235 | CCCGGAUCUCAUCAAUGAC |
| CFB236 | GGAGGAAGCCUCAAAGCUC |
| CFB237 | GACUUUGAACACAUGUUGC |
| CFB238 | UCUCCUCCUCAGACACAAA |
| CFB239 | CAGGAAGGCUCCGUCCCGC |
| CFB240 | CCGCCAGAAUCACCUCUGC |
| CFB241 | UGGAAAGAGAUCUCAUCAC |
| CFB242 | CAAGUCCCGGAUCUCAUCA |
| CFB243 | UGAGCUUGAUCAGGGCAAC |
| CFB244 | UGUUGCUCAUUGUCUUUCU |
| CFB245 | UUGCUUGUGGUAAUCGGUA |
| CFB246 | CUCAUCACUCACAUUGUAG |
| CFB247 | UCAGUGUCCAAGCUGAAAC |
| CFB248 | CCCAUUCUUGAUGUAGACC |
| CFB249 | AAACAAUGUGCUGCUGUCA |
| CFB250 | UGACUUCAACUUGUGGUCU |
| 13(5) as | UUGCCACAGAGACUCAGAG |
| 106-13(4) as | UUGAAUGAAACGACUUCUC |

TABLE 1b

| Nucleobase sequences of the sense strands of 252 constructs | |
|---|---|
| Experimental Label | 15 mer, 14 mer or 11 mer Sense |
| CFB01 | GAUUUGGGUUUUCUA |
| CFB02 | GAUGGAUCAGACAGC |
| CFB03 | CUCUGUGGCAUGGUU |
| CFB04 | GGUGCUAGAUGGAUC |
| CFB05 | GAGGAUUUGGGUUUU |
| CFB06 | CUGGUGCUAGAUGGA |

TABLE 1b-continued

| Nucleobase sequences of the sense strands of 252 constructs | |
|---|---|
| Experimental Label | 15 mer, 14 mer or 11 mer Sense |
| CFB07 | AGGAUUUGGGUUUUC |
| CFB08 | UAGAUGGAUCAGACA |
| CFB09 | AUGAGGAUUUGGGUU |
| CFB10 | UGGUGCUAGAUGGAU |
| CFB11 | UGAGGAUUUGGGUUU |
| CFB12 | GUCUCUGUGGCAUGG |
| CFB13 | GAGUCUCUGUGGCAU |
| CFB14 | CGCCAUGUCAUCAUC |
| CFB15 | GUCAAGGAUAUGGAA |
| CFB16 | AUUCAAGUUGGUGUA |
| CFB17 | UGAGUCUCUGUGGCA |
| CFB18 | UCUCUGUGGCAUGGU |
| CFB19 | CCUGGUGCUAGAUGG |
| CFB20 | UCAAGGAUAUGGAAA |
| CFB21 | GUGCUAGAUGGAUCA |
| CFB22 | CUGAGUCUCUGUGGC |
| CFB23 | UGCUAGAUGGAUCAG |
| CFB24 | ACUCGGAAGGAGGUC |
| CFB25 | CUAGAUGGAUCAGAC |
| CFB26 | CCUUCCUGCCAAGAC |
| CFB27 | UACCUGGUGCUAGAU |
| CFB28 | GUGUCUGAGUACUUU |
| CFB29 | AGAUGGAUCAGACAG |
| CFB30 | ACCUGGUGCUAGAUG |
| CFB31 | AAGAUGAGGAUUUGG |
| CFB32 | AAUUUUAUGACUAUG |
| CFB33 | CAUGUCAUCAUCCUC |
| CFB34 | CAGAACACAGAUUGU |
| CFB35 | CCUGAUCAAGCUCAA |
| CFB36 | GAUCUCUUUCCACUG |
| CFB37 | CUCCAUGAACAUCUA |
| CFB38 | CAACUACCACUUGCC |
| CFB39 | CAAGUUAUGGUGUGA |
| CFB40 | GAUGAGAUCUCUUUC |
| CFB41 | AGACCACAAGUUGAA |
| CFB42 | AAGAGAAGUCGUUUC |
| CFB43 | CAUAUGCCACAUACC |

TABLE 1b-continued

| Nucleobase sequences of the sense strands of 252 constructs | |
|---|---|
| Experimental Label | 15 mer, 14 mer or 11 mer Sense |
| CFB44 | CUUCCAAGAAAGACA |
| CFB45 | GGAUUAUCUGGAUGU |
| CFB46 | UAUGACAAAGUCAAG |
| CFB47 | UAGGUCUGGAGUUUC |
| CFB48 | AGGUGGCAAGUUAUG |
| CFB49 | AUUUUAUGACUAUGA |
| CFB50 | CUUCACAGGAGCCAA |
| CFB51 | UGUCUGAGUACUUUG |
| CFB52 | GAAAGACAAUGAGCA |
| CFB53 | AUUCCUGAAUUUUAU |
| CFB54 | CAGGCCAAGAUCUCA |
| CFB55 | UGAGAGAGAUGCUCA |
| CFB56 | CUGCUAUGACGGUUA |
| CFB57 | GAUAUCAAAGCUCUG |
| CFB58 | CAGCAGCACAUUGUU |
| CFB59 | CUUCUACCCGUACCC |
| CFB60 | CAGGUCUAGGUCUGG |
| CFB61 | AGUUCACAAGAGAAG |
| CFB62 | CAGGAAUUCCUGAAU |
| CFB63 | UAUGGAAAACCUGGA |
| CFB64 | UUUCAUUCAAGUUGG |
| CFB65 | GCUGACAGCAGCACA |
| CFB66 | CUCGGAAGGAGGUCU |
| CFB67 | AGUCAACUUAAUUGA |
| CFB68 | CGGCGAACGUGUCAG |
| CFB69 | CAAGAAAGACAAUGA |
| CFB70 | UUCAUUCAAGUUGGU |
| CFB71 | CUGAGUACUUUGUGC |
| CFB72 | CACCUACCACUGCAG |
| CFB73 | CAUCAUCCUCAUGAC |
| CFB74 | GACCACAAGUUGAAG |
| CFB75 | CUUCCUCCAACUACC |
| CFB76 | CAGUGUACAGCAUGA |
| CFB77 | UUCCAAGAAAGACAA |
| CFB78 | CAUAGAAGGAGUCGA |
| CFB79 | AUUAUCUGGAUGUCU |
| CFB80 | AGGCCAAGAUCUCAG |

TABLE 1b-continued

| Nucleobase sequences of the sense strands of 252 constructs | |
|---|---|
| Experimental Label | 15 mer, 14 mer or 11 mer Sense |
| CFB81 | CUUGAAGACAGCGUC |
| CFB82 | AAGCUUUCCUGUCUU |
| CFB83 | CAACAUGUGUUCAAA |
| CFB84 | UUCCUGAAUUUUAUG |
| CFB85 | GAUGAGGAUUUGGGU |
| CFB86 | UGAUGAGAUCUCUUU |
| CFB87 | AACAUCAAUGCUUUG |
| CFB88 | AAGCAGGAAUUCCUG |
| CFB89 | CAAGACUCCUUCAUG |
| CFB90 | GGUGGCCGAAGCUUU |
| CFB91 | CUAUGACAAAGUCAA |
| CFB92 | AGUUUCAGCUUGGAC |
| CFB93 | AGAUGAGGAUUUGGG |
| CFB94 | AAUUAAAACAGCUGC |
| CFB95 | CAAGAGAAGUCGUUU |
| CFB96 | CUUGGAUGUUCCGGG |
| CFB97 | UGUCUAUGUGUUUGG |
| CFB98 | AGUUAUGGUGUGAAG |
| CFB99 | UAGUUCACAAGAGAA |
| CFB100 | AGGAAUUCCUGAAUU |
| CFB101 | UGGGUCAAAGUGUCU |
| CFB102 | AAGCUCUGUUUGUGU |
| CFB103 | CAAAGCUCUGUUUGU |
| CFB104 | AGGAGAAACUCCAAG |
| CFB105 | AAGUUAUGGUGUGAA |
| CFB106 | AGUCGUUUCAUUCAA |
| CFB107 | AUAUGGAAAACCUGG |
| CFB108 | UGUGAGAGAGAUGCU |
| CFB109 | GAUUAUCUGGAUGUC |
| CFB110 | GAGGGAACAACUCGA |
| CFB111 | UGAGCAACAUGUGUU |
| CFB112 | CAACUUAAUUGAGAA |
| CFB113 | AAUGCUUUGGCUUCC |
| CFB114 | UCUCUUUCCACUGCU |
| CFB115 | CCUCCAGGCAGUGUA |
| CFB116 | UGUGACCAGGUCUAG |
| CFB117 | UCUGUUUGUGUCUGA |

TABLE 1b-continued

| Nucleobase sequences of the sense strands of 252 constructs | |
|---|---|
| Experimental Label | 15 mer, 14 mer or 11 mer Sense |
| CFB118 | UGAAGGAGAAACUCC |
| CFB119 | UGACAGCAGCACAUU |
| CFB120 | AUAUCAAAGCUCUGU |
| CFB121 | CUGCACAGGAUAUCA |
| CFB122 | UAUGACGUUGCCCUG |
| CFB123 | CCAGGUCUAGGUCUG |
| CFB124 | GGUGUCUGAGUACUU |
| CFB125 | CGGGACGGAGCCUUC |
| CFB126 | CUAUGACGUUGCCCU |
| CFB127 | UUGAAUUAAAACAGC |
| CFB128 | GUGAUGAGAUCUCUU |
| CFB129 | CAAUUAUGAAGACCA |
| CFB130 | GAAGCCAAGAUAUGG |
| CFB131 | CAUUCAAGUUGGUGU |
| CFB132 | GAAUUAAAACAGCUG |
| CFB133 | AAGGUGGCAAGUUAU |
| CFB134 | CAGGUACCUGCUCAC |
| CFB135 | GAGGUCUACAUCAAG |
| CFB136 | AACUACCACUUGCCA |
| CFB137 | GCUUUGAGGCUUCCU |
| CFB138 | CAAUUACUGUCAUUG |
| CFB139 | AACAUGUGUUCAAAG |
| CFB140 | CAAGAUGAGGAUUUG |
| CFB141 | GAAGGAGAAACUCCA |
| CFB142 | GGUGGCAAGUUAUGG |
| CFB143 | UGAAUUAAAACAGCU |
| CFB144 | AACAACUCGAGCUUU |
| CFB145 | ACUAUGACGUUGCCC |
| CFB146 | UGGAAAACCUGGAAG |
| CFB147 | AUGGAAAACCUGGAA |
| CFB148 | AUUGCACAACAUGGG |
| CFB149 | AAGUCAAGGAUAUGG |
| CFB150 | UGUGUUCAAAGUCAA |
| CFB151 | AACUCCAAGAUGAGG |
| CFB152 | CAAUGAGCAACAUGU |
| CFB153 | UCAUUCAAGUUGGUG |
| CFB154 | AGACAGCGAUCUGUG |

TABLE 1b-continued

| Nucleobase sequences of the sense strands of 252 constructs | |
|---|---|
| Experimental Label | 15 mer, 14 mer or 11 mer Sense |
| CFB155 | AAAGGCAGCUGUGAG |
| CFB156 | UGAUUCUGGCGGCCC |
| CFB157 | GAGUUUCAGCUUGGA |
| CFB158 | GUUGCCCUGAUCAAG |
| CFB159 | CAUGGUUUGGGAACA |
| CFB160 | CGGCAAAAGCAGGUA |
| CFB161 | AAGACAAUGAGCAAC |
| CFB162 | CAGCGGCGAACGUGU |
| CFB163 | CUACAUCAAGAAUGG |
| CFB164 | CUGAUCAAGCUCAAG |
| CFB165 | UCUACAUCAAGAAUG |
| CFB166 | CCAAGACUCCUUCAU |
| CFB167 | UGGUGUGAAGCCAAG |
| CFB168 | UGUGAAGCCAAGAUA |
| CFB169 | AAGGCAGCUGUGAGA |
| CFB170 | UCAGACAGCAUUGGG |
| CFB171 | UGUGACCACCACUCC |
| CFB172 | GAGUGAGUCCCUAUG |
| CFB173 | CAAGUUGAAGUCAGG |
| CFB174 | AACUUAAUUGAGAAG |
| CFB175 | CUGAAGGAGAAACUC |
| CFB176 | AGGAUAUCAAAGCUC |
| CFB177 | CAAAGUCAAGGACAU |
| CFB178 | CAGACACGUACCUGC |
| CFB179 | GCAGCACAUUGUUUC |
| CFB180 | CCUGCACAGGAUAUC |
| CFB181 | CCAGUCUCUGAGUCU |
| CFB182 | AAUUACUGUCAUUGA |
| CFB183 | CAGGAAGGUGGCUCU |
| CFB184 | UGUUCAAAGUCAAGG |
| CFB185 | AGAAGUCGUUUCAUU |
| CFB186 | GCUUUCCUGUCUUCC |
| CFB187 | CAGGAUAUCAAAGCU |
| CFB188 | GAUCAAGCUCAAGAA |
| CFB189 | GUGCAGAGCAAUCCA |
| CFB190 | AGAUGCUCAAUAUGC |
| CFB191 | UCAAAGUCAAGGAUA |

TABLE 1b-continued

| Nucleobase sequences of the sense strands of 252 constructs | |
|---|---|
| Experimental Label | 15 mer, 14 mer or 11 mer Sense |
| CFB192 | UAGUGGAUGUCUGCA |
| CFB193 | UCGGAAGGAGGUCUA |
| CFB194 | UUAAUUGAGAAGGUG |
| CFB195 | UCCUUCCGACUUCUC |
| CFB196 | CCGUACCCUGUGCAG |
| CFB197 | CCAAUUACUGUCAUU |
| CFB198 | AGUCAGGGACUAACA |
| CFB199 | AAAGUCAAGGAUAUG |
| CFB200 | GUGCAGACACGUACC |
| CFB201 | UACUUUGUGCUGACA |
| CFB202 | AAUUAUGAAGACCAC |
| CFB203 | UCUCUGAGUCUCUGU |
| CFB204 | UAUCUGGAUGUCUAU |
| CFB205 | UGACUCGGAAGGAGG |
| CFB206 | CUUCAGGCUCCAUGA |
| CFB207 | AGUGACAUAUGCCAC |
| CFB208 | GAACAUCAAUGCUUU |
| CFB209 | ACUGGAGGAGUGAGU |
| CFB210 | AAGUCAAGGACAUCU |
| CFB211 | AUUGAAUUAAAACAG |
| CFB212 | UCCAUGAACAUCUAC |
| CFB213 | CUUUCCACUGCUAUG |
| CFB214 | CUGCCAAGUGAAUGG |
| CFB215 | AAGUGAACAUCAAUG |
| CFB216 | UGCUGCCCUGGCUGA |
| CFB217 | GCUUGGACACUGAGC |
| CFB218 | AAAGCCAGUCUCUGA |
| CFB219 | AGGAUUAUCUGGAUG |
| CFB220 | ACUUAAUUGAGAAGG |
| CFB221 | AGGUCUAGGUCUGGA |
| CFB222 | UGACUAUGACGUUGC |
| CFB223 | GUCGUUUCAUUCAAG |
| CFB224 | UGUGUCUGAGGAGGA |
| CFB225 | CAAUGCUUUGGCUUC |
| CFB226 | GAGAAGUCGUUUCAU |
| CFB227 | GAAGACCACAAGUUG |
| CFB228 | GAACAUCUACCUGGU |

TABLE 1b-continued

| Nucleobase sequences of the sense strands of 252 constructs | |
|---|---|
| Experimental Label | 15 mer, 14 mer or 11 mer Sense |
| CFB229 | GUGCCAGAACACAGA |
| CFB230 | GAAGGUGGCAAGUUA |
| CFB231 | CAAGCAACCAUGGCA |
| CFB232 | CAGGCCCAUUUGUCU |
| CFB233 | UGUCUAGUCAACUUA |
| CFB234 | CCGCACCCGCCAUGU |
| CFB235 | UUGAUGAGAUCCGGG |
| CFB236 | UUUGAGGCUUCCUCC |
| CFB237 | CAUGUGUUCAAAGUC |
| CFB238 | UGUCUGAGGAGGAGA |
| CFB239 | GACGGAGCCUUCCUG |
| CFB240 | AGGUGAUUCUGGCGG |
| CFB241 | UGAGAUCUCUUUCCA |
| CFB242 | GAGAUCCGGGACUUG |
| CFB243 | CCCUGAUCAAGCUCA |
| CFB244 | AGACAAUGAGCAACA |
| CFB245 | GAUUACCACAAGCAA |
| CFB246 | AAUGUGAGUGAUGAG |
| CFB247 | CAGCUUGGACACUGA |
| CFB248 | UACAUCAAGAAUGGG |
| CFB249 | AGCAGCACAUUGUUU |
| CFB250 | CACAAGUUGAAGUCA |
| 13(5) s | AGUCUCUGUGGCAA |
| 106-13(4) s | GUUUCAUUCAA |

Table 2 below shows the nucleobase sequences of 250 hairpin constructs selected in accordance with the Examples. The nucleobase sequences are a direct fusion of the antisense sequences of Table 1a with the corresponding sense sequences of Table 1b. For Table 2 the following applies: entry number in the sequence listing=entry number in the Table+500, except for the construct denoted “13(5) as +s” which refers to SEQ ID NO. 755 and the construct denoted “106-13(4) as +s” which refers to SEQ ID NO. 756.

TABLE 2

| Nucleobase sequences of 252 constructs | | |
|---|---|---|
| SEQ ID NO: | Experimental Label | Sequence of 34 mer, 33 mer or 30 mer Hairpin |
| 505 | CFB01 | UAGAAAACCCAAAUCCUCAGAUUUGG-GUUUUCUA |
| 506 | CFB02 | UCUGUCUGAUCCAUCUAGCGAUGGAUCA-GACAGA |

TABLE 2-continued

Nucleobase sequences of 252 constructs

| SEQ ID NO: | Experi-mental Label | Sequence of 34 mer, 33 mer or 30 mer Hairpin |
|---|---|---|
| 507 | CFB03 | UACCAUGCCACAGAGACUCCUCUGUGGCAUG-GUA |
| 508 | CFB04 | UAUCCAUCUAGCACCAGGUGGUGCUAGAUG-GAUA |
| 509 | CFB05 | UAAACCCAAAUCCUCAUCUGAGGAUUUGG-GUUUA |
| 510 | CFB06 | UCCAUCUAGCACCAGGUAGCUGGUGCUA-GAUGGA |
| 511 | CFB07 | UAAAACCCAAAUCCUCAUCAGGAUUUGG-GUUUUA |
| 512 | CFB08 | UGUCUGAUCCAUCUAGCACUAGAUGGAUCA-GACA |
| 513 | CFB09 | UACCCAAAUCCUCAUCUUGAUGAGGAUUUGG-GUA |
| 514 | CFB10 | UUCCAUCUAGCACCAGGUAUGGUGCUAGAUG-GAA |
| 515 | CFB11 | UAACCCAAAUCCUCAUCUUUGAGGAUUUGG-GUUA |
| 516 | CFB12 | UCAUGCCACAGAGACUCAGGUCUCUGUGG-CAUGA |
| 517 | CFB13 | UUGCCACAGAGACUCAGAGGAGUCUCU-GUGGCAA |
| 518 | CFB14 | UAUGAUGACAUGGCGGGUGCGCCAUGUCAU-CAUA |
| 519 | CFB15 | UUCCAUAUCCUUGACUUUGGUCAAGGAUAUG-GAA |
| 520 | CFB16 | UACACCAACUUGAAUGAAAAUUCAAGUUGGU-GUA |
| 521 | CFB17 | UGCCACAGAGACUCAGAGAUGAGUCUCU-GUGGCA |
| 522 | CFB18 | UCCAUGCCACAGAGACUCAUCUCUGUGG-CAUGGA |
| 523 | CFB19 | UCAUCUAGCACCAGGUAGACCUGGUGCUA-GAUGA |
| 524 | CFB20 | UUUCCAUAUCCUUGACUUUUCAAGGAUAUG-GAAA |
| 525 | CFB21 | UGAUCCAUCUAGCACCAGGGUGCUAGAUG-GAUCA |
| 526 | CFB22 | UCCACAGAGACUCAGAGACCUGAGUCUCU-GUGGA |
| 527 | CFB23 | UUGAUCCAUCUAGCACCAGUGCUAGAUGGAU-CAA |
| 528 | CFB24 | UACCUCCUUCCGAGUCAGCACUCGGAAGGAG-GUA |
| 529 | CFB25 | UUCUGAUCCAUCUAGCACCCUAGAUG-GAUCAGAA |
| 530 | CFB26 | UUCUUGGCAGGAAGGCUCCCCUUCCUGC-CAAGAA |
| 531 | CFB27 | UUCUAGCACCAGGUAGAUGUACCUGGUGCUA-GAA |
| 532 | CFB28 | UAAGUACUCAGACACCACAGUGUCUGAGUAC-UUA |
| 533 | CFB29 | UUGUCUGAUCCAUCUAGCAAGAUGGAUCA-GACAA |
| 534 | CFB30 | UAUCUAGCACCAGGUAGAUACCUGGUGCUA-GAUA |
| 535 | CFB31 | UCAAAUCCUCAUCUUGGAGAAGAUGAG-GAUUUGA |
| 536 | CFB32 | UAUAGUCAUAAAAUUCAGGAAUUUUAUGAC-UAUA |
| 537 | CFB33 | UAGGAUGAUGACAUGGCGGCAUGUCAUCAUC-CUA |
| 538 | CFB34 | UCAAUCUGU-GUUCUGGCACCAGAACACAGAUUGA |
| 539 | CFB35 | UUGAGCUUGAUCAGGGCAACCUGAUCAAGCU-CAA |
| 540 | CFB36 | UAGUGGAAAGAGAUCUCAUGAUCUCUUUCCA-CUA |
| 541 | CFB37 | UAGAUGUUCAUGGAGCCUGCUCCAUGAA-CAUCUA |
| 542 | CFB38 | UGCAAGUGGUAGUUGGAGGCAACUACCAC-UUGCA |
| 543 | CFB39 | UCACACCAUAACUUGCCACCAAGUUAUGGU-GUGA |
| 544 | CFB40 | UAAAGAGAUCUCAUCACUCGAUGAGAUCUC-UUUA |
| 545 | CFB41 | UUCAACUUGUGGUCUUCAUAGAC-CACAAGUUGAA |
| 546 | CFB42 | UAAACGACUUCUCUUGUGAAAGAGAAGU-CGUUUA |
| 547 | CFB43 | UGUAUGUGGCAUAUGUCACCAUAUGCCA-CAUACA |
| 548 | CFB44 | UGUCUUUCUUGGAAGCCAACUUCCAAGAAA-GACA |
| 549 | CFB45 | UCAUCCAGAUAAUCCUCCCGGAUUAUCUG-GAUGA |
| 550 | CFB46 | UUUGACUUUGUCAUAGCCUUAUGACAAAGU-CAAA |
| 551 | CFB47 | UAAACUCCAGACCUAGACCUAGGUCUG-GAGUUUA |
| 552 | CFB48 | UAUAACUUGCCACCUUCUCAG-GUGGCAAGUUAUA |
| 553 | CFB49 | UCAUAGUCAUAAAAUUCAGAUUUUAUGAC-UAUGA |
| 554 | CFB50 | UUGGCUCCUGUGAAGUUGCCUUCACAGGAGC-CAA |
| 555 | CFB51 | UAAAGUACUCAGACACCACUGUCUGAGUAC-UUUA |
| 556 | CFB52 | UGCUCAUUGUCUUUCUUGGGAAA-GACAAUGAGCA |
| 557 | CFB53 | UUAAAAUUCAGGAAUUCCUAUUC-CUGAAUUUUAA |
| 558 | CFB54 | UGAGAUCUUGGCCUGCCAUCAGGCCAAGAU-CUCA |
| 559 | CFB55 | UGAGCAUCUCUCUCACAGCUGAGAGAGAUG-CUCA |
| 560 | CFB56 | UAACCGUCAUAGCAGUGGACUGCUAUGACG-GUUA |
| 561 | CFB57 | UAGAGCUUUGAUAUCCUGUGAUAUCAAAGCU-CUA |
| 562 | CFB58 | UACAAUGUGCUGCUGUCAGCAGCAGCACAUU-GUA |
| 563 | CFB59 | UGGUACGGGUAGAAGCCAGCUUC-UACCCGUACCA |
| 564 | CFB60 | UCAGACCUAGACCUGGUCACAGGUCUAGGU-CUGA |
| 565 | CFB61 | UUUCUCUUGUGAACUAUCAAGUU-CACAAGAGAAA |
| 566 | CFB62 | UUUCAGGAAUUCCUGCUUCCAGGAAUUC-CUGAAA |
| 567 | CFB63 | UCCAGGUUUUCCAUAUCCUUAUGGAAAAC-CUGGA |
| 568 | CFB64 | UCAACUUGAAUGAAACGACUUUCAUU-CAAGUUGA |
| 569 | CFB65 | UGUGCUGCUGU-CAGCACAAGCUGACAGCAGCACA |
| 570 | CFB66 | UGACCUCCUUCCGAGUCAGCUCGGAAGGAG-GUCA |
| 571 | CFB67 | UCAAUUAAGUUGACUAGACAGUCAAC-UUAAUUGA |
| 572 | CFB68 | UUGACACGUUCGCCGCUGGCGGCGAACGUGU-CAA |
| 573 | CFB69 | UCAUUGUCUUUCUUGGAAGCAAGAAA-GACAAUGA |
| 574 | CFB70 | UCCAACUUGAAUGAAACGAUUCAUU-CAAGUUGGA |
| 575 | CFB71 | UCACAAAGUACUCAGACACCUGAGUACUUU-GUGA |
| 576 | CFB72 | UUGCAGUGGUAGGUGACGCCACCUACCA-CUGCAA |
| 577 | CFB73 | UUCAUGAGGAUGAUGACAUCAUCAUCCU-CAUGAA |
| 578 | CFB74 | UUUCAACUUGUGGUCUUCAGAC-CACAAGUUGAAA |
| 579 | CFB75 | UGUAGUUGGAGGAAGCCUCCUUCCUCCAAC-UACA |
| 580 | CFB76 | UCAUGCUGUACACUGCCUGCAGUGUACAG-CAUGA |
| 581 | CFB77 | UUGUCUUUCUUGGAAGCCAUUCCAAGAAA-GACAA |
| 582 | CFB78 | UCGACUCCUUCUAUGGUCUCAUAGAAGGAGU-CGA |
| 583 | CFB79 | UGACAUCCAGAUAAUCCUCAUUAUCUGGAU-GUCA |
| 584 | CFB80 | UUGAGAUCUUGGCCUGCCAAGGCCAAGAUCU-CAA |
| 585 | CFB81 | UACGCUGUCUUCAAGGCGGCUUGAA-GACAGCGUA |
| 586 | CFB82 | UAGACAGGAAAGCUUCGGCAAGCUUUCCUGU-CUA |

TABLE 2-continued

Nucleobase sequences of 252 constructs

| SEQ ID NO: | Experimental Label | Sequence of 34 mer, 33 mer or 30 mer Hairpin |
|---|---|---|
| 587 | CFB83 | UUUGAACACAUGUUGCUCACAACAUGUGUU-CAAA |
| 588 | CFB84 | UAUAAAAUUCAGGAAUUCCUUC-CUGAAUUUUAUA |
| 589 | CFB85 | UCCCAAAUCCUCAUCUUGGGAUGAG-GAUUUGGGA |
| 590 | CFB86 | UAAGAGAUCUCAUCACUCAUGAUGAGAUCUC-UUA |
| 591 | CFB87 | UAAAGCAUUGAUGUUCACUAACAUCAAUGC-UUUA |
| 592 | CFB88 | UAGGAAUUCCUGCUUCUUUAAGCAGGAAUUC-CUA |
| 593 | CFB89 | UAUGAAGGAGUCUUGGCAGCAAGACUCCUU-CAUA |
| 594 | CFB90 | UAAGCUUCGGCCACCUCUUGGUGGCCGAAGC-UUA |
| 595 | CFB91 | UUGACUUUGUCAUAGCCUGCUAUGACAAAGU-CAA |
| 596 | CFB92 | UUCCAAGCUGAAACUCCAGAGUUUCAGCUUG-GAA |
| 597 | CFB93 | UCCAAAUCCUCAUCUUGGAAGAUGAG-GAUUUGGA |
| 598 | CFB94 | UCAGCUGUUUUAAUU-CAAUAAUUAAAACAGCUGA |
| 599 | CFB95 | UAACGACUUCUCUUGUGAACAAGAGAAGU-CGUUA |
| 600 | CFB96 | UCCGGAACAUCCAAGCGGGCUUGGAU-GUUCCGGA |
| 601 | CFB97 | UCAAACACAUAGACAUCCAUGUCUAUGU-GUUUGA |
| 602 | CFB98 | UUUCACACCAUAACUUGCCAGUUAUGGU-GUGAAA |
| 603 | CFB99 | UUCUCUUGUGAACUAUCAAUAGUU-CACAAGAGAA |
| 604 | CFB100 | UAUUCAGGAAUUCCUGCUUAGGAAUUC-CUGAAUA |
| 605 | CFB101 | UGACACUUUGACCCAAAUUUGGGUCAAAGU-GUCA |
| 606 | CFB102 | UCACAAACAGAGCUUUGAUAAGCUCUGUUU-GUGA |
| 607 | CFB103 | UCAAACAGAGCUUUGAUAUCAAAGCUCU-GUUUGA |
| 608 | CFB104 | UUUGGAGUUUCUCCUUCAGAGGAGAAACUC-CAAA |
| 609 | CFB105 | UUCACACCAUAACUUGCCAAAGUUAUGGU-GUGAA |
| 610 | CFB106 | UUGAAUGAAACGACUUCUCAGUCGUUUCAUU-CAA |
| 611 | CFB107 | UCAGGUUUUCCAUAUCCUUAUAUGGAAAAC-CUGA |
| 612 | CFB108 | UGCAUCUCUCUCACAGCUGU-GUGAGAGAGAUGCA |
| 613 | CFB109 | UACAUCCAGAUAAUCCUCCGAUUAUCUGGAU-GUA |
| 614 | CFB110 | UCGAGUUGUUCCCUCGGUGGAGGGAACAA-CUCGA |
| 615 | CFB111 | UACACAUGUUGCUCAUUGUUGAGCAACAUGU-GUA |
| 616 | CFB112 | UUCUCAAUUAAGUUGACUACAAC-UUAAUUGAGAA |
| 617 | CFB113 | UGAAGCCAAAGCAUUGAUGAAUGCUUUGGC-UUCA |
| 618 | CFB114 | UGCAGUGGAAAGAGAUCUCUCUUUCCA-CUGCA |
| 619 | CFB115 | UACACUGCCUGGAGGGCCUCCUCCAGGCAGU-GUA |
| 620 | CFB116 | UUAGACCUGGUCACAUUCCUGUGACCAGGUC-UAA |
| 621 | CFB117 | UCAGACACAAACAGAGCUUUCUGUUUGUGU-CUGA |
| 622 | CFB118 | UGAGUUUCUCCUUCAGCCAUGAAGGAGAAA-CUCA |
| 623 | CFB119 | UAUGUGCUGCUGUCAGCACUGACAGCAGCA-CAUA |
| 624 | CFB120 | UCAGAGCUUUGAUAUCCUGAUAUCAAAGCU-CUGA |
| 625 | CFB121 | UGAUAUCCUGUGCAGGGAGCUGCACAG-GAUAUCA |
| 626 | CFB122 | UAGGGCAACGUCAUAGUCAUAUGACGUUGCC-CUA |

TABLE 2-continued

Nucleobase sequences of 252 constructs

| SEQ ID NO: | Experimental Label | Sequence of 34 mer, 33 mer or 30 mer Hairpin |
|---|---|---|
| 627 | CFB123 | UAGACCUAGACCUGGUCACCCAGGUCUAGGU-CUA |
| 628 | CFB124 | UAGUACUCAGACACCACAGGGUGUCUGAGUA-CUA |
| 629 | CFB125 | UAAGGCUCCGUCCCGCUCCCGGGACGGAGCC-UUA |
| 630 | CFB126 | UGGGCAACGUCAUAGUCAUC-UAUGACGUUGCCCA |
| 631 | CFB127 | UCUGUUUUAAUUCAAUCCC-UUGAAUUAAAACAGA |
| 632 | CFB128 | UAGAGAUCUCAUCACUCACGUGAUGAGAUCU-CUA |
| 633 | CFB129 | UGGUCUUCAUAAUUGAUUUCAAUUAUGAA-GACCA |
| 634 | CFB130 | UCAUAUCUUGGCUUCACACGAAGC-CAAGAUAUGA |
| 635 | CFB131 | UCACCAACUUGAAUGAAACCAUUCAAGUUG-GUGA |
| 636 | CFB132 | UAGCUGUUUUAAUU-CAAUCGAAUUAAAACAGCUA |
| 637 | CFB133 | UUAACUUGCCACCUUCUCAAAG-GUGGCAAGUUAA |
| 638 | CFB134 | UUGAGCAGGUACCUGCUUUCAGGUACCUGCU-CAA |
| 639 | CFB135 | UUUGAUGUAGACCUCCUUCGAGGUCUACAU-CAAA |
| 640 | CFB136 | UGGCAAGUGGUAGUUGGAGAACUACCAC-UUGCCA |
| 641 | CFB137 | UGGAAGCCUCAAAGCUCGAGCUUUGAGGC-UUCCA |
| 642 | CFB138 | UAAUGACAGUAAUUGGGUCCAAUUACUGU-CAUUA |
| 643 | CFB139 | UUUUGAACACAUGUUGCUCAACAUGUGUU-CAAAA |
| 644 | CFB140 | UAAAUCCUCAUCUUGGAGUCAAGAUGAG-GAUUUA |
| 645 | CFB141 | UGGAGUUUCUCCUUCAGCCGAAGGAGAAA-CUCCA |
| 646 | CFB142 | UCAUAACUUGCCACCUUCUG-GUGGCAAGUUAUGA |
| 647 | CFB143 | UGCUGUUUUAAUUCAAUC-CUGAAUUAAAACAGCA |
| 648 | CFB144 | UAAGCUCGAGUUGUUCCCUAACAACUCGAGC-UUA |
| 649 | CFB145 | UGGCAACGUCAUAGUCAUAAC-UAUGACGUUGCCA |
| 650 | CFB146 | UUUCCAGGUUUUCCAUAUCUGGAAAACCUG-GAAA |
| 651 | CFB147 | UUCCAGGUUUUCCAUAUCCAUGGAAAACCUG-GAA |
| 652 | CFB148 | UCCAUGUUGUGCAAUCCAUAUUGCACAA-CAUGGA |
| 653 | CFB149 | UCAUAUCCUUGACUUUGAAAAGU-CAAGGAUAUGA |
| 654 | CFB150 | UUGACUUUGAACACAUGUUUGUGUUCAAAGU-CAA |
| 655 | CFB151 | UCUCAUCUUGGAGUUUCUCAACUC-CAAGAUGAGA |
| 656 | CFB152 | UCAUGUUGCUCAUUGUCUUCAAUGAGCAA-CAUGA |
| 657 | CFB153 | UACCAACUUGAAUGAAACGUCAUUCAAGUUG-GUA |
| 658 | CFB154 | UACAGAUCGCUGUCUGCCCAGACAGCGAUCU-GUA |
| 659 | CFB155 | UUCACAGCUGCCUUUCUUAAAAGGCAGCU-GUGAA |
| 660 | CFB156 | UGGCCGCCAGAAUCACCU-CUGAUUCUGGCGGCCA |
| 661 | CFB157 | UCCAAGCUGAAACUCCAGAGAGUUUCAGC-UUGGA |
| 662 | CFB158 | UUUGAUCAGGGCAACGUCAGUUGCCCUGAU-CAAA |
| 663 | CFB159 | UGUUCCCAAACCAUGCCACCAUGGUUUGG-GAACA |
| 664 | CFB160 | UACCUGCUUUUGCCGCUUCCGGCAAAAGCAG-GUA |
| 665 | CFB161 | UUUGCUCAUUGUCUUUCUUAA-GACAAUGAGCAAA |
| 666 | CFB162 | UCACGUUCGCCGCUGG-GAGCAGCGGCGAACGUGA |

TABLE 2-continued

Nucleobase sequences of 252 constructs

| SEQ ID NO: | Experi-mental Label | Sequence of 34 mer, 33 mer or 30 mer Hairpin |
|---|---|---|
| 667 | CFB163 | UCAUUCUUGAUGUAGACCUCUACAU-CAAGAAUGA |
| 668 | CFB164 | UUUGAGCUUGAUCAGGGCACUGAUCAAGCU-CAAA |
| 669 | CFB165 | UAUUCUUGAUGUAGACCUCUCUACAU-CAAGAAUA |
| 670 | CFB166 | UUGAAGGAGUCUUGGCAGGCCAAGACUCCUU-CAA |
| 671 | CFB167 | UUUGGCUUCACACCAUAACUGGUGUGAAGC-CAAA |
| 672 | CFB168 | UAUCUUGGCUUCACACCAUUGUGAAGC-CAAGAUA |
| 673 | CFB169 | UCUCACAGCUGCCUUUCUUAAGGCAGCU-GUGAGA |
| 674 | CFB170 | UCCAAUGCUGUCUGAUCCAUCAGACAG-CAUUGGA |
| 675 | CFB171 | UGAGUGGUGGUCACACCUCUGUGACCACCA-CUCA |
| 676 | CFB172 | UAUAGGGACUCACUCCUCCGAGUGAGUCCC-UAUA |
| 677 | CFB173 | UCUGACUUCAACUUGUGGUCAAGUUGAAGU-CAGA |
| 678 | CFB174 | UUUCUCAAUUAAGUUGACUAAC-UUAAUUGAGAAA |
| 679 | CFB175 | UAGUUUCUCC-UUCAGCCAGCUGAAGGAGAAACUA |
| 680 | CFB176 | UAGCUUUGAUAUCCUGUGCAGGAUAU-CAAAGCUA |
| 681 | CFB177 | UUGUCCUUGACUUUGUCAUCAAAGU-CAAGGACAA |
| 682 | CFB178 | UCAGGUACGUGUCUGCACACAGACACGUAC-CUGA |
| 683 | CFB179 | UAAACAAUGUGCUGCUGUCGCAGCACAUU-GUUUA |
| 684 | CFB180 | UAUAUCCUGUGCAGGGAGCCCUGCACAG-GAUAUA |
| 685 | CFB181 | UGACUCAGAGACUGGCUUUCCAGUCUCUGA-GUCA |
| 686 | CFB182 | UCAAUGACAGUAAUUGGGUAAUUACUGU-CAUUGA |
| 687 | CFB183 | UGAGCCACCUUCCUGACACCAGGAAGGUGG-CUCA |
| 688 | CFB184 | UCUUGACUUUGAACACAUGUGUUCAAAGU-CAAGA |
| 689 | CFB185 | UAUGAAACGACUUCUCUUGAGAAGUCGUUU-CAUA |
| 690 | CFB186 | UGAAGACAGGAAAGCUUCGGCUUUCCUGUC-UUCA |
| 691 | CFB187 | UGCUUUGAUAUCCUGUGCACAGGAUAU-CAAAGCA |
| 692 | CFB188 | UUCUUGAGCUUGAUCAGGGGAUCAAGCU-CAAGAA |
| 693 | CFB189 | UGGAUUGCUCUGCACUCUG-GUGCAGAGCAAUCCA |
| 694 | CFB190 | UCAUAUUGAGCAUCUCUCUAGAUGCU-CAAUAUGA |
| 695 | CFB191 | UAUCCUUGACUUUGAACACUCAAAGU-CAAGGAUA |
| 696 | CFB192 | UGCAGACAUCCACUACUCCUAGUGGAUGU-CUGCA |
| 697 | CFB193 | UAGACCUCCUUCCGAGUCAUCGGAAGGAGGU-CUA |
| 698 | CFB194 | UACCUUCUCAAUUAAGUUGUUAAUUGAGAAG-GUA |
| 699 | CFB195 | UAGAAGUCGGAAGGAGCCGUCCUUCCGAC-UUCUA |
| 700 | CFB196 | UUGCACAGGGUACGGGUAGCCGUACCCU-GUGCAA |
| 701 | CFB197 | UAUGACAGUAAUUGGGUCCCCAAUUACUGU-CAUA |
| 702 | CFB198 | UGUUAGUCCCUGACUUCAAAGUCAGGGAC-UAACA |
| 703 | CFB199 | UAUAUCCUUGACUUUGAACAAAGU-CAAGGAUAUA |
| 704 | CFB200 | UGUACGUGUCUGCACAGGGGUGCA-GACACGUACA |
| 705 | CFB201 | UGUCAGCACAAAGUACUCAUACUUU-GUGCUGACA |
| 706 | CFB202 | UUGGUCUUCAUAAUUGAUUAAUUAUGAAGAC-CAA |
| 707 | CFB203 | UCAGAGACUCAGAGACUGGUCUCUGAGUCU-CUGA |
| 708 | CFB204 | UUAGACAUCCAGAUAAUCCUAUCUGGAUGUC-UAA |
| 709 | CFB205 | UCUCCUUCCGAGUCAGCUUUGACUCG-GAAGGAGA |
| 710 | CFB206 | UCAUGGAGCCUGAAGGGUCCUUCAGGCUC-CAUGA |
| 711 | CFB207 | UUGGCAUAUGUCACUAGACAGUGACAUAUGC-CAA |
| 712 | CFB208 | UAAGCAUUGAUGUUCACUUGAACAUCAAUGC-UUA |
| 713 | CFB209 | UCUCACUCCUCCAGUACAAACUGGAG-GAGUGAGA |
| 714 | CFB210 | UGAUGUCCUUGACUUUGUCAAGUCAAGGA-CAUCA |
| 715 | CFB211 | UUGUUUUAAUUCAAUCC-CAAUUGAAUUAAAACAA |
| 716 | CFB212 | UUAGAUGUUCAUGGAGCCUUCCAUGAACAUC-UAA |
| 717 | CFB213 | UAUAGCAGUGGAAAGAGAUCUUUCCACUGC-UAUA |
| 718 | CFB214 | UCAUUCACUUGGCAGGUGCCUGC-CAAGUGAAUGA |
| 719 | CFB215 | UAUUGAUGUUCACUUGGUUAAGUGAACAU-CAAUA |
| 720 | CFB216 | UCAGCCAGGGCAGCACUUGUGCUGCC-CUGGCUGA |
| 721 | CFB217 | UCUCAGUGUCCAAGCUGAAGCUUGGACA-CUGAGA |
| 722 | CFB218 | UCAGAGACUGGCUUUCAUCAAAGCCAGUCU-CUGA |
| 723 | CFB219 | UAUCCAGAUAAUCCUCCCUAGGAUUAUCUG-GAUA |
| 724 | CFB220 | UCUUCUCAAUUAAGUUGACAC-UUAAUUGAGAAGA |
| 725 | CFB221 | UCCAGACCUAGACCUGGUCAGGUCUAGGU-CUGGA |
| 726 | CFB222 | UCAACGUCAUAGUCAUAAAUGAC-UAUGACGUUGA |
| 727 | CFB223 | UUUGAAUGAAACGACUUCUGUCGUUUCAUU-CAAA |
| 728 | CFB224 | UCCUCCUCAGACACAAACAUGUGUCUGAG-GAGGA |
| 729 | CFB225 | UAAGCCAAAGCAUUGAUGUCAAUGCUUUGGC-UUA |
| 730 | CFB226 | UUGAAACGACUUCUCUUGUGAGAAGUCGUUU-CAA |
| 731 | CFB227 | UAACUUGUGGUCUUCAUAAGAAGAC-CACAAGUUA |
| 732 | CFB228 | UCCAGGUAGAUGUUCAUGGGAACAUCUAC-CUGGA |
| 733 | CFB229 | UCUGUGUUCUGGCAC-CUGCGUGCCAGAACACAGA |
| 734 | CFB230 | UAACUUGCCACCUUCUCAAGAAG-GUGGCAAGUUA |
| 735 | CFB231 | UGCCAUGGUUGCUUGUGGUCAAGCAAC-CAUGGCA |
| 736 | CFB232 | UGACAAAUGGGCCUGAUAGCAGGCCCAUUU-GUCA |
| 737 | CFB233 | UAAGUUGACUAGACACUUUUGUCUAGUCAAC-UUA |
| 738 | CFB234 | UCAUGGCGGGUGCGGUUCCCCGCACCCGC-CAUGA |
| 739 | CFB235 | UCCGGAUCUCAUCAAUGAC-UUGAUGAGAUCCGGA |
| 740 | CFB236 | UGAGGAAGCCUCAAAGCUCUUUGAGGCUUC-CUCA |
| 741 | CFB237 | UACUUUGAACACAUGUUGCCAUGUGUUCAA-AGUA |
| 742 | CFB238 | UCUCCUCCUCAGACACAAAUGUCUGAGGAG-GAGA |
| 743 | CFB239 | UAGGAAGGCUCCGUCCCGCGACGGAGCCUUC-CUA |
| 744 | CFB240 | UCGCCAGAAUCACCUCUGCAG-GUGAUUCUGGCGA |
| 745 | CFB241 | UGGAAAGAGAUCUCAUCACUGAGAUCUC-UUUCCA |
| 746 | CFB242 | UAAGUCCCGGAUCUCAUCAGAGAUCCGGGAC-UUA |

TABLE 2-continued

| Nucleobase sequences of 252 constructs | | |
|---|---|---|
| SEQ ID NO: | Experimental Label | Sequence of 34 mer, 33 mer or 30 mer Hairpin |
| 747 | CFB243 | UGAGCUUGAUCAGGGCAACCCCUGAUCAAG-CUCA |
| 748 | CFB244 | UGUUGCUCAUUGUCUUUCUA-GACAAUGAGCAACA |
| 749 | CFB245 | UUGCUUGUGGUAAUCGGUAGAUUAC-CACAAGCAA |
| 750 | CFB246 | UUCAUCACUCACAUUGUAGAAU-GUGAGUGAUGAA |
| 751 | CFB247 | UCAGUGUCCAAGCUGAAACCAGCUUGGACA-CUGA |
| 752 | CFB248 | UCCAUUCUUGAUGUAGACCUACAU-CAAGAAUGGA |
| 753 | CFB249 | UAACAAUGUGCUGCUGUCAAGCAGCACAUU-GUUA |
| 754 | CFB250 | UGACUUCAACUUGUGGUCUCACAAGUUGAA-GUCA |
| 755 | 13(5) as + s | UUGCCACAGAGACUCAGAGAGUCUCUGUGGCAA |
| 756 | 106-13(4) as + s | UUGAAUGAAACGACUUCUCGUUUCAUUCAA |

Table 3 below shows 252 hairpins with full modification information (modified sugars and, where applicable, modified phosphates).

TABLE 3

| Modified hairpin constructs | | |
|---|---|---|
| # | SEQ ID NO: | |
| 1 | 757 | PmU.fA.mG.mA.mA.mA.mA.mC.mC.mC.mA.mA.mA.fU.mC.mC.mU.mC.mA.mG.mA.fU.fU-.fU.mG.mG.mG.mU.mU.mU.mU.mC.mU.mA |
| 2 | 758 | PmU.fC.mU.mG.mU.mC.mU.mG.mA.mU.mC.mC.mA.fU.mC.mU.mA.mG.mC.mG.mA.fU.fG.fG.mA-.mU.mC.mA.mG.mA.mC.mA.mG.mA |
| 3 | 759 | PmU.fA.mC.mC.mA.mU.mG.mC.mC.mA.mC.mA.mG.fA.mG.mA.mC.mU.mC.mC.mU.fC.fU.fG-.mU.mG.mG.mC.mA.mU.mG.mG.mU.mA |
| 4 | 760 | PmU.fA.mU.mC.mC.mA.mU.mC.mU.mA.mG.mC.mA.fC.mC.mA.mG.mG.mU.mG.mG.fU.fG.fC.mU-.mA.mG.mA.mU.mG.mG.mA.mU.mA |
| 5 | 761 | PmU.fA.mA.mA.mC.mC.mC.mA.mA.mA.mU.mC.mC.fU.mC.mA.mU.mC.mU.mG.mA.fG.fG.fA.mU-.mU.mU.mG.mG.mG.mU.mU.mU.mA |
| 6 | 762 | PmU.fC.mC.mA.mU.mC.mU.mA.mG.mC.mA.mC.mC.fA.mG.mG.mU.mA.mG.mC-.mU.fG.fG.fU.mG.mC.mU.mA.mG.mA.mU.mG.mG.mA |
| 7 | 763 | PmU.fA.mA.mA.mA.mC.mC.mC.mA.mA.mA.mU.mC.fC.mU.mC.mA.mU.mC.mA.mG.fG.fA.fU.mU-.mU.mG.mG.mG.mU.mU.mU.mU.mA |
| 8 | 764 | PmU.fG.mU.mC.mU.mG.mA.mU.mC.mC.mA.mU.mC.fU.mA.mG.mC.mA.mC.mU.mA.fG.fA-.fU.mG.mG.mA.mU.mC.mA.mG.mA.mC.mA |
| 9 | 765 | PmU.fA.mC.mC.mC.mA.mA.mA.mU.mC.mC.mU.mC.fA.mU.mC.mU.mU.mG.mA.mU.fG.fA.fG.mG-.mA.mU.mU.mU.mG.mG.mG.mU.mA |
| 10 | 766 | PmU.fU.mC.mC.mA.mU.mC.mU.mA.mG.mC.mA.mC.fC.mA.mG.mG.mU.mA.mU.mG.fG.fU.fG.mC-.mU.mA.mG.mA.mU.mG.mG.mA.mA |
| 11 | 767 | PmU.fA.mA.mC.mC.mC.mA.mA.mA.mU.mC.mC.mU.fC.mA.mU.mC.mU.mU.mU.mG.fA.fG.fG.mA-.mU.mU.mU.mG.mG.mG.mU.mU.mA |
| 12 | 768 | PmU.fC.mA.mU.mG.mC.mC.mA.mC.mA.mG.mA.mG.fA.mC.mU.mC.mA.mG.mG.mU.fC.fU.fC-.mU.mG.mU.mG.mG.mC.mA.mU.mG.mA |
| 13 | 769 | PmU.fU.mG.mC.mC.mA.mC.mA.mG.mA.mG.mA.mC.fU.mC.mA.mG.mA.mG.mG.mA.fG.fU.fC-.mU.mC.mU.mG.mU.mG.mG.mC.mA.mA |
| 14 | 770 | PmU.fA.mU.mG.mA.mU.mG.mA.mC.mA.mU.mG.mG.fC.mG.mG.mG.mU.mG.mC.mG.fC.fC.fA-.mU.mG.mU.mC.mA.mU.mC.mA.mU.mA |

TABLE 3-continued

| Modified hairpin constructs | | |
|---|---|---|
| # | SEQ ID NO: | |
| 15 | 771 | PmU.fU.mC.mC.mA.mU.mA.mU.mC.mC.mU.mU.mG.fA.mC.mU.mU.mU.mG.mG.mU.fC.fA-<br>.fA.mG.mG.mA.<br>mU.mA.mU.mG.mG.mA.mA |
| 16 | 772 | PmU.fA.mC.mA.mC.mC.mA.mA.mC.mU.mU.mG.mA.fA.mU.mG.mA.mA.mA.mA.mU.fU.fC.fA.mA.mG.mU<br>mU.mG.mG.mU.mG.mU.mA |
| 17 | 773 | PmU.fG.mC.mC.mA.mC.mA.mG.mA.mG.mA.mC.mU.fC.mA.mG.mA.mG.mA.mU.mG.fA.fG.fU.mC-<br>.mU.mC.<br>mU.mG.mU.mG.mG.mC.mA |
| 18 | 774 | PmU.fC.mC.mA.mU.mG.mC.mC.mA.mC.mA.mG.mA.fG.mA.mC.mU.mC.mA.mU.mC.fU.fC.fU.mG-<br>.mU.mG.<br>mG.mC.mA.mU.mG.mG.mA |
| 19 | 775 | PmU.fC.mA.mU.mC.mU.mA.mG.mC.mA.mC.mC.mA.fG.mG.mU.mA.mG.mA.mC.mC.fU.fG.fG-<br>.mU.mG.mC.<br>mU.mA.mG.mA.mU.mG.mA |
| 20 | 776 | PmU.fU.mU.mC.mC.mA.mU.mA.mU.mC.mC.mU.mU.fG.mA.mC.mU.mU.mU.mU.mC.fA.fA.fG.mG-<br>.mA.mU.<br>mA.mU.mG.mG.mA.mA.mA |
| 21 | 777 | PmU.fG.mA.mU.mC.mC.mA.mU.mC.mU.mA.mG.mC.fA.mC.mC.mA.mG.mG.mG.mU.fG.fC.fU-<br>.mA.mG.mA.<br>mU.mG.mG.mA.mU.mC.mA |
| 22 | 778 | PmU.fC.mC.mA.mC.mA.mG.mA.mG.mA.mC.mU.mC.fA.mG.mA.mG.mA.mC.mC.mU.fG.fA.fG-<br>.mU.mC.mU.<br>mC.mU.mG.mU.mG.mG.mA |
| 23 | 779 | PmU.fU.mG.mA.mU.mC.mC.mA.mU.mC.mU.mA.mG.fC.mA.mC.mC.mA.mG.mU.mG.fC.fU.fA.mG-<br>.mA.mU.<br>mG.mG.mA.mU.mC.mA.mA |
| 24 | 780 | PmU.fA.mC.mC.mU.mC.mC.mU.mU.mC.mC.mG.mA.fG.mU.mC.mA.mG.mC.mA.mC.fU.fC.fG.mG-<br>.mA.mA.<br>mG.mG.mA.mG.mG.mU.mA |
| 25 | 781 | PmU.fU.mC.mU.mG.mA.mU.mC.mC.mA.mU.mC.mU.fA.mG.mC.mA.mC.mC.mC.mU.fA.fG.fA-<br>.mU.mG.mG.<br>mA.mU.mC.mA.mG.mA.mA |
| 26 | 782 | PmU.fU.mC.mU.mU.mG.mG.mC.mA.mG.mG.mA.mA.fG.mG.mC.mU.mC.mC.mC.mC.fU.fU.fC.mC-<br>.mU.mG.<br>mC.mC.mA.mA.mG.mA.mA |
| 27 | 783 | PmU.fU.mC.mU.mA.mG.mC.mA.mC.mC.mA.mG.mG.fU.mA.mG.mA.mU.mG.mU.mA-<br>.fC.fC.fU.mG.mG.mU.<br>mG.mC.mU.mA.mG.mA.mA |
| 28 | 784 | PmU.fA.mA.mG.mU.mA.mC.mU.mC.mA.mG.mA.mC.fA.mC.mC.mA.mC.mA.mG.mU.fG.fU.fC-<br>.mU.mG.mA.<br>mG.mU.mA.mC.mU.mU.mA |
| 29 | 785 | PmU.fU.mG.mU.mC.mU.mG.mA.mU.mC.mC.mA.mU.fC.mU.mA.mG.mC.mA.mA.mG.fA.fU.fG.mG-<br>.mA.mU.<br>mC.mA.mG.mA.mC.mA.mA |
| 30 | 786 | PmU.fA.mU.mC.mU.mA.mG.mC.mA.mC.mC.mA.mG.fG.mU.mA.mG.mA.mU.mA.mC.fC.fU.fG.mG-<br>.mU.mG.<br>mC.mU.mA.mG.mA.mU.mA |
| 31 | 787 | PmU.fC.mA.mA.mA.mU.mC.mC.mU.mC.mA.mU.mC.fU.mU.mG.mG.mA.mG.mA.mA.fG.fA.fU.mG-<br>.mA.mG.<br>mG.mA.mU.mU.mU.mG.mA |
| 32 | 788 | PmU.fA.mU.mA.mG.mU.mC.mA.mU.mA.mA.mA.mA.fU.mU.mC.mA.mG.mG.mA.mA.fU.fU.fU.mU-<br>.mA.mU.<br>mG.mA.mC.mU.mA.mU.mA |
| 33 | 789 | PmU.fA.mG.mG.mA.mU.mG.mA.mU.mG.mA.mC.mA.fU.mG.mG.mC.mG.mG.mC.mA.fU.fG.fU.mC-<br>.mA.mU.<br>mC.mA.mU.mC.mC.mU.mA |

TABLE 3-continued

Modified hairpin constructs

| # | SEQ ID NO: | |
|---|---|---|
| 34 | 790 | PmU.fC.mA.mA.mU.mC.mU.mG.mU.mG.mU.mU.mC.fU.mG.mG.mC.mA.mC.mC.mA.fG.fA.fA.mC-.mA.mC.mA.mG.mA.mU.mU.mG.mA |
| 35 | 791 | PmU.fU.mG.mA.mG.mC.mU.mU.mG.mA.mU.mC.mA.fG.mG.mG.mC.mA.mA.mC.mC.fU.fG.fA-.mU.mC.mA.mA.mG.mC.mU.mC.mA.mA |
| 36 | 792 | PmU.fA.mG.mU.mG.mG.mA.mA.mA.mG.mA.mG.mA.fU.mC.mU.mC.mA.mU.mG.mA.fU.fC.fU.mC-.mU.mU.mU.mC.mC.mA.mC.mU.mA |
| 37 | 793 | PmU.fA.mG.mA.mU.mG.mU.mU.mC.mA.mU.mG.mG.fA.mG.mC.mC.mU.mG.mC.mU.fC.fC.fA-.mU.mG.mA.mA.mC.mA.mU.mC.mU.mA |
| 38 | 794 | PmU.fG.mC.mA.mA.mG.mU.mG.mG.mU.mA.mG.mU.fU.mG.mG.mA.mG.mG.mC.mA.fA.fC.fU.mA.m-C.mC.mA.mC.mU.mU.mG.mC.mA |
| 39 | 795 | PmU.fC.mA.mC.mA.mC.mC.mA.mU.mA.mA.mC.mU.fU.mG.mC.mC.mA.mC.mC.mA.fA.fG.fU.mU-.mA.mU.mG.mG.mU.mG.mU.mG.mA |
| 40 | 796 | PmU.fA.mA.mA.mG.mA.mG.mA.mU.mC.mU.mC.mA.fU.mC.mA.mC.mU.mC.mG.mA.fU.fG.fA.mG-.mA.mU.mC.mU.mC.mU.mU.mU.mA |
| 41 | 797 | PmU.fU.mC.mA.mA.mC.mU.mU.mG.mU.mG.mG.mU.fC.mU.mU.mC.mA.mU.mA.mG.fA.fC.fC.mA.m-C.mA.mA.mG.mU.mU.mG.mA.mA |
| 42 | 798 | PmU.fA.mA.mA.mC.mG.mA.mC.mU.mU.mC.mU.mC.fU.mU.mG.mU.mG.mA.mA.mA.fG.fA.fG.mA-.mA.mG.mU.mC.mG.mU.mU.mU.mA |
| 43 | 799 | PmU.fG.mU.mA.mU.mG.mU.mG.mG.mC.mA.mU.mA.fU.mG.mU.mC.mA.mC.mC.mA.fU.fA-.fU.mG.mC.mC.mA.mC.mA.mU.mA.mC.mA |
| 44 | 800 | PmU.fG.mU.mC.mU.mU.mU.mC.mU.mU.mG.mG.mA.fA.mG.mC.mC.mA.mA.mC.mU.fU.fC.fC.mA-.mA.mG.mA.mA.mA.mG.mA.mC.mA |
| 45 | 801 | PmU.fC.mA.mU.mC.mC.mA.mG.mA.mU.mA.mA.mU.fC.mC.mU.mC.mC.mC.mG.mG.fA.fU.fU.mA-.mU.mC.mU.mG.mG.mA.mU.mG.mA |
| 46 | 802 | PmU.fU.mU.mG.mA.mC.mU.mU.mU.mG.mU.mC.mA.fU.mA.mG.mC.mC.mU.mU.mA.fU.fG.fA.mC-.mA.mA.mA.mG.mU.mC.mA.mA.mA |
| 47 | 803 | PmU.fA.mA.mA.mC.mU.mC.mC.mA.mG.mA.mC.mC.fU.mA.mG.mA.mC.mC.mU.mA.fG.fG.fU.mC-.mU.mG.mG.mA.mG.mU.mU.mU.mA |
| 48 | 804 | PmU.fA.mU.mA.mA.mC.mU.mU.mG.mC.mC.mA.mC.fC.mU.mU.mC.mU.mC-.mA.mG.fG.fU.fG.mG.mC.mA.mA.mG.mU.mU.mA.mU.mA |
| 49 | 805 | PmU.fC.mA.mU.mA.mG.mU.mC.mA.mU.mA.mA.mA.fA.mU.mU.mC.mA.mG.mA.mU.fU.fU.fU.mA-.mU.mG.mA.mC.mU.mA.mU.mG.mA |
| 50 | 806 | PmU.fU.mG.mG.mC.mU.mC.mC.mU.mG.mU.mG.mA.fA.mG.mU.mU.mG.mC.mC.mU.fU.fC.fA.mC-.mA.mG.mG.mA.mG.mC.mC.mA.mA |
| 51 | 807 | PmU.fA.mA.mA.mG.mU.mA.mC.mU.mC.mA.mG.mA.fC.mA.mC.mC.mA.mC.mU.mG.fU.fC.fU.mG-.mA.mG.mU.mA.mC.mU.mU.mU.mA |
| 52 | 808 | PmU.fG.mC.mU.mC.mA.mU.mU.mG.mU.mC.mU.mU.fU.mC.mU.mU.mG.mG.mG.mA.fA.fA.fG.mA.m-C.mA.mA.mU.mG.mA.mG.mC.mA |

TABLE 3-continued

| Modified hairpin constructs | | |
|---|---|---|
| # | SEQ ID NO: | |
| 53 | 809 | PmU.fU.mA.mA.mA.mA.mU.mU.mC.mA.mG.mG.mA.fA.mU.mU.mC.mC.mU.mA.mU.fU.fC.fC-.mU.mG.mA.mA.mU.mU.mU.mU.mA.mA |
| 54 | 810 | PmU.fG.mA.mG.mA.mU.mC.mU.mU.mG.mG.mC.mC.fU.mG.mC.mC.mA.mU.mC.mA.fG.fG.fC.mC-.mA.mA.mG.mA.mU.mC.mU.mC.mA |
| 55 | 811 | PmU.fG.mA.mG.mC.mA.mU.mC.mU.mC.mU.mC.mU.fC.mA.mC.mA.mG.mC.mU.mG.fA.fG.fA.mG-.mA.mG.mA.mU.mG.mC.mU.mC.mA |
| 56 | 812 | PmU.fA.mA.mC.mC.mG.mU.mC.mA.mU.mA.mG.mC.fA.mG.mU.mG.mG.mA.mC.mU.fG.fC.fU.mA-.mU.mG.mA.mC.mG.mG.mU.mU.mA |
| 57 | 813 | PmU.fA.mG.mA.mG.mC.mU.mU.mU.mG.mA.mU.mA.fU.mC.mC.mU.mG.mU.mG.mA.fU.fA.fU.mC-.mA.mA.mA.mG.mC.mU.mC.mU.mA |
| 58 | 814 | PmU.fA.mC.mA.mA.mU.mG.mU.mG.mC.mU.mG.mC.fU.mG.mU.mC.mA.mG.mC.mA-.fG.fC.fA.mG.mC.mA.mC.mA.mU.mU.mG.mU.mA |
| 59 | 815 | PmU.fG.mG.mU.mA.mC.mG.mG.mG.mU.mA.mG.mA.fA.mG.mC.mC.mA.mG.mC.mU.fU.fC.fU.mA.m-C.mC.mC.mG.mU.mA.mC.mC.mA |
| 60 | 816 | PmU.fC.mA.mG.mA.mC.mC.mU.mA.mG.mA.mC.mC.fU.mG.mG.mU.mC.mA.mC.mA.fG.fG.fU.mC-.mU.mA.mG.mG.mU.mC.mU.mG.mA |
| 61 | 817 | PmU.fU.mU.mC.mU.mC.mU.mU.mG.mU.mG.mA.mA.fC.mU.mA.mU.mC.mA.mA.mG.fU.fU.fC.mA.m-C.mA.mA.mG.mA.mG.mA.mA.mA |
| 62 | 818 | PmU.fU.mU.mC.mA.mG.mG.mA.mA.mU.mU.mC.mC.fU.mG.mC.mU.mU.mC.mC.mA.fG.fG.fA.mA-.mU.mU.mC.mC.mU.mG.mA.mA.mA |
| 63 | 819 | PmU.fC.mC.mA.mG.mG.mU.mU.mU.mU.mC.mC.mA.fU.mA.mU.mC.mC.mU.mU.mA.fU.fG.fG.mA-.mA.mA.mA.mC.mC.mU.mG.mG.mA |
| 64 | 820 | PmU.fC.mA.mA.mC.mU.mU.mG.mA.mA.mU.mG.mA.fA.mA.mC.mG.mA.mC.mU.mU.fU.fC.fA.mU-.mU.mC.mA.mA.mG.mU.mU.mG.mA |
| 65 | 821 | PmU.fG.mU.mG.mC.mU.mG.mC.mU.mG.mU.mC.mA.fG.mC.mA.mC.mA.mA.mG.mC.fU.fG.fA.mC-.mA.mG.mC.mA.mG.mC.mA.mC.mA |
| 66 | 822 | PmU.fG.mA.mC.mC.mU.mC.mC.mU.mU.mC.mC.mG.fA.mG.mU.mC.mA.mG.mC.mU.fC.fG.fG.mA-.mA.mG.mG.mA.mG.mG.mU.mC.mA |
| 67 | 823 | PmU.fC.mA.mA.mU.mU.mA.mA.mG.mU.mU.mG.mA.fC.mU.mA.mG.mA.mC.mA.mG.fU.fC.fA.mA.m-C.mU.mU.mA.mA.mU.mU.mG.mA |
| 68 | 824 | PmU.fU.mG.mA.mC.mA.mC.mG.mU.mU.mC.mG.mC.fC.mG.mC.mU.mG.mG.mC.mG.fG.fC.fG.mA-.mA.mC.mG.mU.mG.mU.mC.mA.mA |
| 69 | 825 | PmU.fC.mA.mU.mU.mG.mU.mC.mU.mU.mU.mC.mU.fU.mG.mG.mA.mA.mG.mC.mA.fA.fG.fA.mA-.mA.mG.mA.mC.mA.mA.mU.mG.mA |
| 70 | 826 | PmU.fC.mC.mA.mA.mC.mU.mU.mG.mA.mA.mU.mG.fA.mA.mA.mC.mG.mA.mU.mU.fC.fA.fU-.mU.mC.mA.mA.mG.mU.mU.mG.mG.mA |
| 71 | 827 | PmU.fC.mA.mC.mA.mA.mA.mG.mU.mA.mC.mU.mC.fA.mG.mA.mC.mA.mC.mC.mU.fG.fA.fG.mU-.mA.mC.mU.mU.mU.mG.mU.mG.mA |

TABLE 3-continued

Modified hairpin constructs

| # | SEQ ID NO: | |
|---|---|---|
| 72 | 828 | PmU.fU.mG.mC.mA.mG.mU.mG.mG.mU.mA.mG.mG.fU.mG.mA.mC.mG.mC.mC.mA.fC.fC.fU.mA.m-C.mC.mA.mC.mU.mG.mC.mA.mA |
| 73 | 829 | PmU.fU.mC.mA.mU.mG.mA.mG.mG.mA.mU.mG.mA.fU.mG.mA.mC.mA.mU.mC.mA.fU.fC.fA-.mU.mC.mC.mU.mC.mA.mU.mG.mA.mA |
| 74 | 830 | PmU.fU.mU.mC.mA.mA.mC.mU.mU.mG.mU.mG.mG.fU.mC.mU.mU.mC.mA.mG.mA.fC.fC.fA.mC-.mA.mA.mG.mU.mU.mG.mA.mA.mA |
| 75 | 831 | PmU.fG.mU.mA.mG.mU.mU.mG.mG.mA.mG.mG.mA.fA.mG.mC.mC.mU.mC.mC.mU.fU.fC.fC-.mU.mC.mC.mA.mA.mC.mU.mA.mC.mA |
| 76 | 832 | PmU.fC.mA.mU.mG.mC.mU.mG.mU.mA.mC.mA.mC.fU.mG.mC.mC.mU.mG.mC.mA.fG.fU.fG.mU-.mA.mC.mA.mG.mC.mA.mU.mG.mA |
| 77 | 833 | PmU.fU.mG.mU.mC.mU.mU.mU.mC.mU.mU.mG.mG.fA.mA.mG.mC.mC.mA.mU.mU.fC.fC.fA-.mA.mG.mA.mA.mA.mG.mA.mC.mA.mA |
| 78 | 834 | PmU.fC.mG.mA.mC.mU.mC.mC.mU.mU.mC.mU.mA.fU.mG.mG.mU.mC.mU.mC.mA.fU.fA.fG.mA-.mA.mG.mG.mA.mG.mU.mC.mG.mA |
| 79 | 835 | PmU.fG.mA.mC.mA.mU.mC.mC.mA.mG.mA.mU.mA.fA.mU.mC.mC.mU.mC.mA.mU.fU.fA.fU.mC-.mU.mG.mG.mA.mU.mG.mU.mC.mA |
| 80 | 836 | PmU.fU.mG.mA.mG.mA.mU.mC.mU.mU.mG.mG.mC.fC.mU.mG.mC.mC.mA.mA.mG.fG.fC.fC.mA-.mA.mG.mA.mU.mC.mU.mC.mA.mA |
| 81 | 837 | PmU.fA.mC.mG.mC.mU.mG.mU.mC.mU.mU.mC.mA.fA.mG.mG.mC.mG.mG.mC.mU.fU.fG.fA-.mA.mG.mA.mC.mA.mG.mC.mG.mU.mA |
| 82 | 838 | PmU.fA.mG.mA.mC.mA.mG.mG.mA.mA.mA.mG.mC.fU.mU.mC.mG.mG.mC.mA.mA.fG.fC.fU.mU-.mU.mC.mC.mU.mG.mU.mC.mU.mA |
| 83 | 839 | PmU.fU.mU.mG.mA.mA.mC.mA.mC.mA.mU.mG.mU.fU.mG.mC.mU.mC.mA.mC.mA.fA.fC.fA-.mU.mG.mU.mG.mU.mU.mC.mA.mA.mA |
| 84 | 840 | PmU.fA.mU.mA.mA.mA.mA.mU.mU.mC.mA.mG.mG.fA.mA.mU.mU.mC.mC.mU.mU.fC.fC.fU.mG-.mA.mA.mU.mU.mU.mU.mA.mU.mA |
| 85 | 841 | PmU.fC.mC.mC.mA.mA.mA.mU.mC.mC.mU.mC.mA.fU.mC.mU.mU.mG.mG.mG.mA-.fU.fG.fA.mG.mG.mA.mU.mU.mU.mG.mG.mG.mA |
| 86 | 842 | PmU.fA.mA.mG.mA.mG.mA.mU.mC.mU.mC.mA.mU.fC.mA.mC.mU.mC.mA.mU.mG.fA.fU.fG-.mA.mG.mA.mU.mC.mU.mC.mU.mU.mA |
| 87 | 843 | PmU.fA.mA.mA.mG.mC.mA.mU.mU.mG.mA.mU.mG.fU.mU.mC.mA.mC.mU.mA.mA.fC.fA.fU.mC-.mA.mA.mU.mG.mC.mU.mU.mU.mA |
| 88 | 844 | PmU.fA.mG.mG.mA.mA.mU.mU.mC.mC.mU.mG.mC.fU.mU.mC.mU.mU.mU.mA.mA-.fG.fC.fA.mG.mG.mA.mA.mU.mU.mC.mC.mU.mA |
| 89 | 845 | PmU.fA.mU.mG.mA.mA.mG.mG.mA.mG.mU.mC.mU.fU.mG.mG.mC.mA.mG.mC.mA.fA.fG.fA.mC-.mU.mC.mC.mU.mU.mC.mA.mU.mA |
| 90 | 846 | PmU.fA.mA.mG.mC.mU.mU.mC.mG.mG.mC.mC.mA.fC.mC.mU.mC.mU-.mU.mG.mG.fU.fG.fG.mC.mC.mG.mA.mA.mG.mC.mU.mU.mA |

TABLE 3-continued

Modified hairpin constructs

| # | SEQ ID NO: | |
|---|---|---|
| 91 | 847 | PmU.fU.mG.mA.mC.mU.mU.mU.mG.mU.mC.mA.mU.fA.mG.mC.mC.mU.mG.mC.mU.fA.fU.fG.mA.m-C.mA.<br>mA.mA.mG.mU.mC.mA.mA |
| 92 | 848 | PmU.fU.mC.mC.mA.mA.mG.mC.mU.mG.mA.mA.mA.fC.mU.mC.mC.mA.mG.mA.mG.fU.fU.fU.mC-.mA.mG.<br>mC.mU.mU.mG.mG.mA.mA |
| 93 | 849 | PmU.fC.mC.mA.mA.mA.mU.mC.mC.mU.mC.mA.mU.fC.mU.mU.mG.mG.mA.mA.mG.fA.fU.fG-.mA.mG.mG.<br>mA.mU.mU.mU.mG.mG.mA |
| 94 | 850 | PmU.fC.mA.mG.mC.mU.mG.mU.mU.mU.mU.mA.mA.fU.mU.mC.mA.mA.mU.mA.mA.fU.fU.fA.mA-.mA.mA.<br>mC.mA.mG.mC.mU.mG.mA |
| 95 | 851 | PmU.fA.mA.mC.mG.mA.mC.mU.mU.mC.mU.mC.mU.fU.mG.mU.mG.mA.mA.mC.mA.fA.fG.fA.mG-.mA.mA.<br>mG.mU.mC.mG.mU.mU.mA |
| 96 | 852 | PmU.fC.mC.mG.mG.mA.mA.mC.mA.mU.mC.mC.mA.fA.mG.mC.mG.mG.mG.mC.mU.fU.fG.fG.mA-.mU.mG.<br>mU.mU.mC.mC.mG.mG.mA |
| 97 | 853 | PmU.fC.mA.mA.mA.mC.mA.mC.mA.mU.mA.mG.mA.fC.mA.mU.mC.mC.mA.mU.mG.fU.fC.fU.mA-.mU.mG.<br>mU.mG.mU.mU.mU.mG.mA |
| 98 | 854 | PmU.fU.mU.mC.mA.mC.mA.mC.mC.mA.mU.mA.mA.fC.mU.mU.mG.mC.mC.mA.mG.fU.fU.fA-.mU.mG.mG.<br>mU.mG.mU.mG.mA.mA.mA |
| 99 | 855 | PmU.fU.mC.mU.mC.mU.mU.mG.mU.mG.mA.mA.mC.fU.mA.mU.mC.mA.mA.mU.mA.fG.fU.fU.mC-.mA.mC.<br>mA.mA.mG.mA.mG.mA.mA |
| 100 | 856 | PmU.fA.mU.mU.mC.mA.mG.mG.mA.mA.mU.mU.mC.fC.mU.mG.mC.mU.mU.mA.mG.fG.fA.fA.mU-.mU.mC.<br>mC.mU.mG.mA.mA.mU.mA |
| 101 | 857 | PmU.fG.mA.mC.mA.mC.mU.mU.mU.mG.mA.mC.mC.fC.mA.mA.mA.mU.mU.mU.mG.fG.fG.fU.mC-.mA.mA.<br>mA.mG.mU.mG.mU.mC.mA |
| 102 | 858 | PmU.fC.mA.mC.mA.mA.mA.mC.mA.mG.mA.mG.mC.fU.mU.mU.mG.mA.mU.mA.mA.fG.fC.fU.mC-.mU.mG.<br>mU.mU.mU.mG.mU.mG.mA |
| 103 | 859 | PmU.fC.mA.mA.mA.mC.mA.mG.mA.mG.mC.mU.mU.fU.mG.mA.mU.mA.mU.mC.mA.fA.fA.fG.mC-.mU.mC.<br>mU.mG.mU.mU.mU.mG.mA |
| 104 | 860 | PmU.fU.mU.mG.mG.mA.mG.mU.mU.mU.mC.mU.mC.fC.mU.mU.mC.mA.mG.mA.mG.fG.fA.fG.mA-.mA.mA.<br>mC.mU.mC.mC.mA.mA.mA |
| 105 | 861 | PmU.fU.mC.mA.mC.mA.mC.mC.mA.mU.mA.mA.mC.fU.mU.mG.mC.mC.mA.mA.mA.fG.fU.fU.mA-.mU.mG.<br>mG.mU.mG.mU.mG.mA.mA |
| 106 | 862 | PmU.fU.mG.mA.mA.mU.mG.mA.mA.mA.mC.mG.mA.fC.mU.mU.mC.mU.mC.mA.mG.fU.fC.fG.mU-.mU.mU.<br>mC.mA.mU.mU.mC.mA.mA |
| 107 | 863 | PmU.fC.mA.mG.mG.mU.mU.mU.mU.mC.mC.mA.mU.fA.mU.mC.mC.mU.mU.mA.mU.fA.fU.fG.mG-.mA.mA.<br>mA.mA.mC.mC.mU.mG.mA |
| 108 | 864 | PmU.fG.mC.mA.mU.mC.mU.mC.mU.mC.mU.mC.mA.fC.mA.mG.mC.mU.mG.mU.mG.fU.fG.fA.mG-.mA.mG.<br>mA.mG.mA.mU.mG.mC.mA |
| 109 | 865 | PmU.fA.mC.mA.mU.mC.mC.mA.mG.mA.mU.mA.mA.fU.mC.mC.mU.mC.mC.mG.mA.fU.fU.fA-.mU.mC.mU.<br>mG.mG.mA.mU.mG.mU.mA |

TABLE 3-continued

Modified hairpin constructs

| # | SEQ ID NO: | |
|---|---|---|
| 110 | 866 | PmU.fC.mG.mA.mG.mU.mU.mG.mU.mU.mC.mC.mC.fU.mC.mG.mG.mU.mG.mG.mA.fG.fG.fG.mA-.mA.mC.<br>mA.mA.mC.mU.mC.mG.mA |
| 111 | 867 | PmU.fA.mC.mA.mC.mA.mU.mG.mU.mU.mG.mC.mU.fC.mA.mU.mU.mG.mU.mU.mG.fA.fG.fC.mA-.mA.mC.<br>mA.mU.mG.mU.mG.mU.mA |
| 112 | 868 | PmU.fU.mC.mU.mC.mA.mA.mU.mU.mA.mA.mG.mU.fU.mG.mA.mC.mU.mA.mC.mA.fA.fC.fU.mU-.mA.mA.<br>mU.mU.mG.mA.mG.mA.mA |
| 113 | 869 | PmU.fG.mA.mA.mG.mC.mC.mA.mA.mA.mG.mC.mA.fU.mU.mG.mA.mU.mG.mA.mA.fU.fG.fC.mU-.mU.mU.<br>mG.mG.mC.mU.mU.mC.mA |
| 114 | 870 | PmU.fG.mC.mA.mG.mU.mG.mG.mA.mA.mA.mG.mA.fG.mA.mU.mC.mU.mC.mU.mC.fU.fC.fU.mU-.mU.mC.<br>mC.mA.mC.mU.mG.mC.mA |
| 115 | 871 | PmU.fA.mC.mA.mC.mU.mG.mC.mC.mU.mG.mG.mA.fG.mG.mG.mC.mC.mU.mC.mC.fU.fC.fC-.mA.mG.mG.<br>mC.mA.mG.mU.mG.mU.mA |
| 116 | 872 | PmU.fU.mA.mG.mA.mC.mC.mU.mG.mG.mU.mC.mA.fC.mA.mU.mU.mC.mC.mU.mG.fU.fG.fA.m-C.mC.mA.<br>mG.mG.mU.mC.mU.mA.mA |
| 117 | 873 | PmU.fC.mA.mG.mA.mC.mA.mC.mA.mA.mA.mC.mA.fG.mA.mG.mC.mU.mU.mU.mC.fU.fG.fU.mU-.mU.mG.<br>mU.mG.mU.mC.mU.mG.mA |
| 118 | 874 | PmU.fG.mA.mG.mU.mU.mU.mC.mU.mC.mC.mU.mU.fC.mA.mG.mC.mC.mA.mU.mG.fA.fA.fG.mG-.mA.mG.<br>mA.mA.mA.mC.mU.mC.mA |
| 119 | 875 | PmU.fA.mU.mG.mU.mG.mC.mU.mG.mC.mU.mG.mU.fC.mA.mG.mC.mA.mC-.mU.mG.fA.fC.fA.mG.mC.mA.<br>mG.mC.mA.mC.mA.mU.mA |
| 120 | 876 | PmU.fC.mA.mG.mA.mG.mC.mU.mU.mU.mG.mA.mU.fA.mU.mC.mC.mU.mG.mA.mU.fA.fU.fC.mA-.mA.mA.<br>mG.mC.mU.mC.mU.mG.mA |
| 121 | 877 | PmU.fG.mA.mU.mA.mU.mC.mC.mU.mG.mU.mG.mC.fA.mG.mG.mG.mA.mG.mC.mU.fG.fC.fA.mC-.mA.mG.<br>mG.mA.mU.mA.mU.mC.mA |
| 122 | 878 | PmU.fA.mG.mG.mG.mC.mA.mA.mC.mG.mU.mC.mA.fU.mA.mG.mU.mC.mA.mU.mA.fU.fG.fA.m-C.mG.mU.<br>mU.mG.mC.mC.mC.mU.mA |
| 123 | 879 | PmU.fA.mG.mA.mC.mC.mU.mA.mG.mA.mC.mC.mU.fG.mG.mU.mC.mA.mC.mC.mC.fA.fG.fG-.mU.mC.mU.<br>mA.mG.mG.mU.mC.mU.mA |
| 124 | 880 | PmU.fA.mG.mU.mA.mC.mU.mC.mA.mG.mA.mC.mA.fC.mC.mA.mC.mA.mG.mG.mG.fU.fG.fU.mC-.mU.mG.<br>mA.mG.mU.mA.mC.mU.mA |
| 125 | 881 | PmU.fA.mA.mG.mG.mC.mU.mC.mC.mG.mU.mC.mC.fC.mG.mC.mU.mC.mC.mC.mG.fG.fG.fA.m-C.mG.mG.<br>mA.mG.mC.mC.mU.mU.mA |
| 126 | 882 | PmU.fG.mG.mG.mC.mA.mA.mC.mG.mU.mC.mA.mU.fA.mG.mU.mC.mA.mU.mC.mU.fA.fU.fG.mA.m-C.mG.<br>mU.mU.mG.mC.mC.mC.mA |
| 127 | 883 | PmU.fC.mU.mG.mU.mU.mU.mU.mA.mA.mU.mU.mC.fA.mA.mU.mC.mC.mC.mU.mU.fG.fA.fA.mU-.mU.mA.<br>mA.mA.mA.mC.mA.mG.mA |
| 128 | 884 | PmU.fA.mG.mA.mG.mA.mU.mC.mU.mC.mA.mU.mC.fA.mC.mU.mC.mA.mC.mG.mU.fG.fA.fU.mG-.mA.mG.<br>mA.mU.mC.mU.mC.mU.mA |

TABLE 3-continued

| Modified hairpin constructs | | |
|---|---|---|
| # | SEQ ID NO: | |
| 129 | 885 | PmU.fG.mG.mU.mC.mU.mU.mC.mA.mU.mA.mA.mU.fU.mG.mA.mU.mU.mU.mC.mA.fA.fU.fU.mA-.mU.mG.mA.mA.mG.mA.mC.mC.mA |
| 130 | 886 | PmU.fC.mA.mU.mA.mU.mC.mU.mU.mG.mG.mC.mU.fU.mC.mA.mC.mA.mC.mG.mA.fA.fG.fC.mC-.mA.mA.mG.mA.mU.mA.mU.mG.mA |
| 131 | 887 | PmU.fC.mA.mC.mC.mA.mA.mC.mU.mU.mG.mA.mA.fU.mG.mA.mA.mA.mC.mC.mA.fU.fU.fC.mA-.mA.mG.mU.mU.mG.mG.mU.mG.mA |
| 132 | 888 | PmU.fA.mG.mC.mU.mG.mU.mU.mU.mU.mA.mA.mU.fU.mC.mA.mA.mU.mC.mG.mA.fA.fU.fU.mA-.mA.mA.mA.mC.mA.mG.mC.mU.mA |
| 133 | 889 | PmU.fU.mA.mA.mC.mU.mU.mG.mC.mC.mA.mC.mC.fU.mU.mC.mU.mC.mA.mA.mA-.fG.fG.fU.mG.mG.mC.mA.mA.mG.mU.mU.mA.mA |
| 134 | 890 | PmU.fU.mG.mA.mG.mC.mA.mG.mG.mU.mA.mC.mC.fU.mG.mC.mU.mU.mU.mC.mA.fG.fG.fU.mA.m-C.mC.mU.mG.mC.mU.mC.mA.mA |
| 135 | 891 | PmU.fU.mU.mG.mA.mU.mG.mU.mA.mG.mA.mC.mC.fU.mC.mC.mU.mU.mC.mG.mA.fG.fG.fU.mC-.mU.mA.mC.mA.mU.mC.mA.mA.mA |
| 136 | 892 | PmU.fG.mG.mC.mA.mA.mG.mU.mG.mG.mU.mA.mG.fU.mU.mG.mG.mA.mG.mA.mA.fC.fU.fA.m-C.mC.mA.mC.mU.mU.mG.mC.mC.mA |
| 137 | 893 | PmU.fG.mG.mA.mA.mG.mC.mC.mU.mC.mA.mA.mA.fG.mC.mU.mC.mG.mA.mG.mC.fU.fU.fU.mG-.mA.mG.mG.mC.mU.mU.mC.mC.mA |
| 138 | 894 | PmU.fA.mA.mU.mG.mA.mC.mA.mG.mU.mA.mA.mU.fU.mG.mG.mG.mU.mC.mC.mA.fA.fU.fU.mA.m-C.mU.mG.mU.mC.mA.mU.mU.mA |
| 139 | 895 | PmU.fU.mU.mU.mG.mA.mA.mC.mA.mC.mA.mU.mG.fU.mU.mG.mC.mU.mC.mA.mA.fC.fA.fU.mG-.mU.mG.mU.mU.mC.mA.mA.mA.mA |
| 140 | 896 | PmU.fA.mA.mA.mU.mC.mC.mU.mC.mA.mU.mC.mU.fU.mG.mG.mA.mG.mU.mC.mA.fA.fG.fA-.mU.mG.mA.mG.mG.mA.mU.mU.mU.mA |
| 141 | 897 | PmU.fG.mG.mA.mG.mU.mU.mU.mC.mU.mC.mC.mU.fU.mC.mA.mG.mC.mC.mG.mA.fA.fG.fG-.mA.mG.mA.mA.mA.mC.mU.mC.mC.mA |
| 142 | 898 | PmU.fC.mA.mU.mA.mA.mC.mU.mU.mG.mC.mC.mA.fC.mC.mU.mU.mC.mU.mG.mG.fU.fG.fG.mC-.mA.mA.mG.mU.mU.mA.mU.mG.mA |
| 143 | 899 | PmU.fG.mC.mU.mG.mU.mU.mU.mU.mA.mA.mU.mU.fC.mA.mA.mU.mC.mC.mU.mG.fA.fA.fU.mU-.mA.mA.mA.mA.mC.mA.mG.mC.mA |
| 144 | 900 | PmU.fA.mA.mG.mC.mU.mC.mG.mA.mG.mU.mU.mG.fU.mU.mC.mC.mC.mU.mA.mA.fC.fA.fA.mC-.mU.mC.mG.mA.mG.mC.mU.mU.mA |
| 145 | 901 | PmU.fG.mG.mC.mA.mA.mC.mG.mU.mC.mA.mU.mA.fG.mU.mC.mA.mU.mA.mA.mC.fU.fA.fU.mG-.mA.mC.mG.mU.mU.mG.mC.mC.mA |
| 146 | 902 | PmU.fU.mU.mC.mC.mA.mG.mG.mU.mU.mU.mU.mC.fC.mA.mU.mA.mU.mC.mU.mG.fG.fA.fA.mA-.mA.mC.mC.mU.mG.mG.mA.mA.mA |
| 147 | 903 | PmU.fU.mC.mC.mA.mG.mG.mU.mU.mU.mU.mC.mC.fA.mU.mA.mU.mC.mC.mA.mU.fG.fG.fA.mA-.mA.mA.mC.mC.mU.mG.mG.mA.mA |

TABLE 3-continued

| Modified hairpin constructs | | |
|---|---|---|
| # | SEQ ID NO: | |
| 148 | 904 | PmU.fC.mC.mA.mU.mG.mU.mU.mG.mU.mG.mC.mA.fA.mU.mC.mC.mA.mU.mA.mU.fU.fG.fC.mA.m-C.mA.<br>mA.mC.mA.mU.mG.mG.mA |
| 149 | 905 | PmU.fC.mA.mU.mA.mU.mC.mC.mU.mU.mG.mA.mC.fU.mU.mU.mG.mA.mA.mA.mA.fG.fU.fC.mA-.mA.mG.<br>mG.mA.mU.mA.mU.mG.mA |
| 150 | 906 | PmU.fU.mG.mA.mC.mU.mU.mU.mG.mA.mA.mC.mA.fC.mA.mU.mG.mU.mU.mU.mG.fU.fG.fU-.mU.mC.mA.<br>mA.mA.mG.mU.mC.mA.mA |
| 151 | 907 | PmU.fC.mU.mC.mA.mU.mC.mU.mU.mG.mG.mA.mG.fU.mU.mU.mC.mU.mC.mA.mA.fC.fU.fC.mC-.mA.mA.<br>mG.mA.mU.mG.mA.mG.mA |
| 152 | 908 | PmU.fC.mA.mU.mG.mU.mU.mG.mC.mU.mC.mA.mU.fU.mG.mU.mC.mU.mU.mC.mA.fA.fU.fG-.mA.mG.mC.<br>mA.mA.mC.mA.mU.mG.mA |
| 153 | 909 | PmU.fA.mC.mC.mA.mA.mC.mU.mU.mG.mA.mA.mU.fG.mA.mA.mA.mC.mG.mU.mC.fA.fU.fU.mC-.mA.mA.<br>mG.mU.mU.mG.mG.mU.mA |
| 154 | 910 | PmU.fA.mC.mA.mG.mA.mU.mC.mG.mC.mU.mG.mU.fC.mU.mG.mC.mC.mC-.mA.mG.fA.fC.fA.mG.mC.mG.<br>mA.mU.mC.mU.mG.mU.mA |
| 155 | 911 | PmU.fU.mC.mA.mC.mA.mG.mC.mU.mG.mC.mC.mU.fU.mU.mC.mU.mU.mA.mA.mA.fA.fG.fG.mC-.mA.mG.<br>mC.mU.mG.mU.mG.mA.mA |
| 156 | 912 | PmU.fG.mG.mC.mC.mG.mC.mC.mA.mG.mA.mA.mU.fC.mA.mC.mC.mU.mC.mU.mG.fA.fU.fU.mC-.mU.mG.<br>mG.mC.mG.mG.mC.mC.mA |
| 157 | 913 | PmU.fC.mC.mA.mA.mG.mC.mU.mG.mA.mA.mA.mC.fU.mC.mC.mA.mG.mA.mG.mA.fG.fU.fU-.mU.mC.mA.<br>mG.mC.mU.mU.mG.mG.mA |
| 158 | 914 | PmU.fU.mU.mG.mA.mU.mC.mA.mG.mG.mG.mC.mA.fA.mC.mG.mU.mC.mA.mG.mU-.fU.fG.fC.mC.mC.mU.<br>mG.mA.mU.mC.mA.mA.mA |
| 159 | 915 | PmU.fG.mU.mU.mC.mC.mC.mA.mA.mA.mC.mC.mA.fU.mG.mC.mC.mA.mC.mC.mA.fU.fG.fG.mU-.mU.mU.<br>mG.mG.mG.mA.mA.mC.mA |
| 160 | 916 | PmU.fA.mC.mC.mU.mG.mC.mU.mU.mU.mU.mG.mC.fC.mG.mC.mU.mU.mC.mC.mG.fG.fC.fA.mA-.mA.mA.<br>mG.mC.mA.mG.mG.mU.mA |
| 161 | 917 | PmU.fU.mU.mG.mC.mU.mC.mA.mU.mU.mG.mU.mC.fU.mU.mU.mC.mU.mU.mA.mA.fG.fA.fC.mA-.mA.mU.<br>mG.mA.mG.mC.mA.mA.mA |
| 162 | 918 | PmU.fC.mA.mC.mG.mU.mU.mC.mG.mC.mC.mG.mC.fU.mG.mG.mG.mA.mG.mC.mA-.fG.fC.fG.mG.mC.mG.<br>mA.mA.mC.mG.mU.mG.mA |
| 163 | 919 | PmU.fC.mA.mU.mU.mC.mU.mU.mG.mA.mU.mG.mU.fA.mG.mA.mC.mC.mU.mC.mU.fA.fC.fA-.mU.mC.mA.<br>mA.mG.mA.mA.mU.mG.mA |
| 164 | 920 | PmU.fU.mU.mG.mA.mG.mC.mU.mU.mG.mA.mU.mC.fA.mG.mG.mG.mC.mA.mC.mU.fG.fA.fU.mC-.mA.mA.<br>mG.mC.mU.mC.mA.mA.mA |
| 165 | 921 | PmU.fA.mU.mU.mC.mU.mU.mG.mA.mU.mG.mU.mA.fG.mA.mC.mC.mU.mC.mU.mC.fU.fA.fC.mA-.mU.mC.<br>mA.mA.mG.mA.mA.mU.mA |
| 166 | 922 | PmU.fU.mG.mA.mA.mG.mG.mA.mG.mU.mC.mU.mU.fG.mG.mC.mA.mG.mG.mC.mC.fA.fA.fG.mA.m-C.mU.<br>mC.mC.mU.mU.mC.mA.mA |

TABLE 3-continued

| Modified hairpin constructs | | |
|---|---|---|
| # | SEQ ID NO: | |
| 167 | 923 | PmU.fU.mU.mG.mG.mC.mU.mU.mC.mA.mC.mA.mC.fC.mA.mU.mA.mA.mC.mU.mG.fG.fU.fG-.mU.mG.mA.mA.mG.mC.mC.mA.mA.mA |
| 168 | 924 | PmU.fA.mU.mC.mU.mU.mG.mG.mC.mU.mU.mC.mA.fC.mA.mC.mC.mA.mU.mU.mG.fU.fG.fA-.mA.mG.mC.mC.mA.mA.mG.mA.mU.mA |
| 169 | 925 | PmU.fC.mU.mC.mA.mC.mA.mG.mC.mU.mG.mC.mC.fU.mU.mU.mC.mU.mU.mA.mA.fG.fG.fC-.mA.mG.mC.mU.mG.mU.mG.mA.mG.mA |
| 170 | 926 | PmU.fC.mC.mA.mA.mU.mG.mC.mU.mG.mU.mC.mU.fG.mA.mU.mC.mC.mA.mU.mC.fA.fG.fA.mC-.mA.mG.mC.mA.mU.mU.mG.mG.mA |
| 171 | 927 | PmU.fG.mA.mG.mU.mG.mG.mU.mG.mG.mU.mC.mA.fC.mA.mC.mC.mU.mC.mU.mG.fU.fG.fA.m-C.mC.mA.mC.mC.mA.mC.mU.mC.mA |
| 172 | 928 | PmU.fA.mU.mA.mG.mG.mG.mA.mC.mU.mC.mA.mC.fU.mC.mC.mU.mC.mC.mG.mA.fG.fU.fG-.mA.mG.mU.mC.mC.mC.mU.mA.mU.mA |
| 173 | 929 | PmU.fC.mU.mG.mA.mC.mU.mU.mC.mA.mA.mC.mU.fU.mG.mU.mG.mG.mU.mC.mA.fA.fG.fU-.mU.mG.mA.mA.mG.mU.mC.mA.mG.mA |
| 174 | 930 | PmU.fU.mU.mC.mU.mC.mA.mA.mU.mU.mA.mA.mG.fU.mU.mG.mA.mC.mU.mA.mA.fC.fU.fU.mA-.mA.mU.mU.mG.mA.mG.mA.mA.mA |
| 175 | 931 | PmU.fA.mG.mU.mU.mU.mC.mU.mC.mC.mU.mU.mC.fA.mG.mC.mC.mA.mG.mC.mU.fG.fA-.fA.mG.mG.mA.mG.mA.mA.mA.mC.mU.mA |
| 176 | 932 | PmU.fA.mG.mC.mU.mU.mU.mG.mA.mU.mA.mU.mC.fC.mU.mG.mU.mG.mC.mA.mG.fG.fA.fU.mA-.mU.mC.mA.mA.mA.mG.mC.mU.mA |
| 177 | 933 | PmU.fU.mG.mU.mC.mC.mU.mU.mG.mA.mC.mU.mU.fU.mG.mU.mC.mA.mU.mC.mA.fA.fA.fG-.mU.mC.mA.mA.mG.mG.mA.mC.mA.mA |
| 178 | 934 | PmU.fC.mA.mG.mG.mU.mA.mC.mG.mU.mG.mU.mC.fU.mG.mC.mA.mC.mA.mC.mA.fG.fA.fC.mA.m-C.mG.mU.mA.mC.mC.mU.mG.mA |
| 179 | 935 | PmU.fA.mA.mA.mC.mA.mA.mU.mG.mU.mG.mC.mU.fG.mC.mU.mG.mU.mC.mG.mC.fA.fG.fC.mA.m-C.mA.mU.mU.mG.mU.mU.mU.mA |
| 180 | 936 | PmU.fA.mU.mA.mU.mC.mC.mU.mG.mU.mG.mC.mA.fG.mG.mG.mA.mG.mC.mC.mC.fU.fG.fC.mA.m-C.mA.mG.mG.mA.mU.mA.mU.mA |
| 181 | 937 | PmU.fG.mA.mC.mU.mC.mA.mG.mA.mG.mA.mC.mU.fG.mG.mC.mU.mU.mU.mC.mC.fA.fG.fU.mC-.mU.mC.mU.mG.mA.mG.mU.mC.mA |
| 182 | 398 | PmU.fC.mA.mA.mU.mG.mA.mC.mA.mG.mU.mA.mA.fU.mU.mG.mG.mG.mU.mA.mA.fU.fU.fA.mC-.mU.mG.mU.mC.mA.mU.mU.mG.mA |
| 183 | 939 | PmU.fG.mA.mG.mC.mC.mA.mC.mC.mU.mU.mC.mC.fU.mG.mA.mC.mA.mC.mC.mA.fG.fG.fA-.mA.mG.mG.mU.mG.mG.mC.mU.mC.mA |
| 184 | 940 | PmU.fC.mU.mU.mG.mA.mC.mU.mU.mU.mG.mA.mA.fC.mA.mC.mA.mU.mG.mU.mG.fU.fU.fC.mA-.mA.mA.mG.mU.mC.mA.mA.mG.mA |
| 185 | 941 | PmU.fA.mU.mG.mA.mA.mA.mC.mG.mA.mC.mU.mU.fC.mU.mC.mU.mU.mG.mA.mG.fA.fA.fG-.mU.mC.mG.mU.mU.mU.mC.mA.mU.mA |

TABLE 3-continued

| Modified hairpin constructs | | |
|---|---|---|
| # | SEQ ID NO: | |
| 186 | 942 | PmU.fG.mA.mA.mG.mA.mC.mA.mG.mG.mA.mA.mA.fG.mC.mU.mU.mC.mG.mG.mC.fU.fU-.fU.mC.mC.mU.mG.mU.mC.mU.mU.mC.mA |
| 187 | 943 | PmU.fG.mC.mU.mU.mU.mG.mA.mU.mA.mU.mC.mC.fU.mG.mU.mG.mC.mA.mC.mA.fG.fG.fA.mU-.mA.mU.mC.mA.mA.mA.mG.mC.mA |
| 188 | 944 | PmU.fU.mC.mU.mU.mG.mA.mG.mC.mU.mU.mG.mA.fU.mC.mA.mG.mG.mG.mG.mA.fU.fC.fA-.mA.mG.mC.mU.mC.mA.mA.mG.mA.mA |
| 189 | 945 | PmU.fG.mG.mA.mU.mU.mG.mC.mU.mC.mU.mG.mC.fA.mC.mU.mC.mU.mG.mG.mU.fG.fC.fA.mG-.mA.mG.mC.mA.mA.mU.mC.mC.mA |
| 190 | 946 | PmU.fC.mA.mU.mA.mU.mU.mG.mA.mG.mC.mA.mU.fC.mU.mC.mU.mC.mU.mA.mG.fA.fU.fG.mC-.mU.mC.mA.mA.mU.mA.mU.mG.mA |
| 191 | 947 | PmU.fA.mU.mC.mC.mU.mU.mG.mA.mC.mU.mU.mU.fG.mA.mA.mC.mA.mC.mU.mC.fA.fA.fA.mG-.mU.mC.mA.mA.mG.mG.mA.mU.mA |
| 192 | 948 | PmU.fG.mC.mA.mG.mA.mC.mA.mU.mC.mC.mA.mC.fU.mA.mC.mU.mC.mC.mU.mA.fG.fU.fG.mG-.mA.mU.mG.mU.mC.mU.mG.mC.mA |
| 193 | 949 | PmU.fA.mG.mA.mC.mC.mU.mC.mC.mU.mU.mC.mC.fG.mA.mG.mU.mC.mA.mU.mC.fG.fG.fA-.mA.mG.mG.mA.mG.mG.mU.mC.mU.mA |
| 194 | 950 | PmU.fA.mC.mC.mU.mU.mC.mU.mC.mA.mA.mU.mU.fA.mA.mG.mU.mU.mG.mU.mU.fA.fA.fU-.mU.mG.mA.mG.mA.mA.mG.mG.mU.mA |
| 195 | 951 | PmU.fA.mG.mA.mA.mG.mU.mC.mG.mG.mA.mA.mG.fG.mA.mG.mC.mC.mG.mU.mC.fC.fU-.fU.mC.mC.mG.mA.mC.mU.mU.mC.mU.mA |
| 196 | 952 | PmU.fU.mG.mC.mA.mC.mA.mG.mG.mG.mU.mA.mC.fG.mG.mG.mU.mA.mG.mC.mC.fG.fU.fA.m-C.mC.mC.mU.mG.mU.mG.mC.mA.mA |
| 197 | 953 | PmU.fA.mU.mG.mA.mC.mA.mG.mU.mA.mA.mU.mU.fG.mG.mG.mU.mC.mC.mC.mC.fA.fA.fU.mU-.mA.mC.mU.mG.mU.mC.mA.mU.mA |
| 198 | 954 | PmU.fG.mU.mU.mA.mG.mU.mC.mC.mC.mU.mG.mA.fC.mU.mU.mC.mA.mA-.mA.mG.fU.fC.fA.mG.mG.mG.mA.mC.mU.mA.mA.mC.mA |
| 199 | 955 | PmU.fA.mU.mA.mU.mC.mC.mU.mU.mG.mA.mC.mU.fU.mU.mG.mA.mA.mC.mA.mA.fA.fG.fU.mC-.mA.mA.mG.mG.mA.mU.mA.mU.mA |
| 200 | 956 | PmU.fG.mU.mA.mC.mG.mU.mG.mU.mC.mU.mG.mC.fA.mC.mA.mG.mG.mG.mG.mU.fG.fC.fA.mG-.mA.mC.mA.mC.mG.mU.mA.mC.mA |
| 201 | 957 | PmU.fG.mU.mC.mA.mG.mC.mA.mC.mA.mA.mA.mG.fU.mA.mC.mU.mC.mA.mU.mA.fC.fU.fU-.mU.mG.mU.mG.mC.mU.mG.mA.mC.mA |
| 202 | 958 | PmU.fU.mG.mG.mU.mC.mU.mU.mC.mA.mU.mA.mA.fU.mU.mG.mA.mU.mU.mA.mA.fU.fU.fA-.mU.mG.mA.mA.mG.mA.mC.mC.mA.mA |
| 203 | 959 | PmU.fC.mA.mG.mA.mG.mA.mC.mU.mC.mA.mG.mA.fG.mA.mC.mU.mG.mG.mU.mC.fU.fC.fU.mG-.mA.mG.mU.mC.mU.mC.mU.mG.mA |
| 204 | 960 | PmU.fU.mA.mG.mA.mC.mA.mU.mC.mC.mA.mG.mA.fU.mA.mA.mU.mC.mC.mU.mA-.fU.fC.fU.mG.mG.mA.mU.mG.mU.mC.mU.mA.mA |

TABLE 3-continued

Modified hairpin constructs

| # | SEQ ID NO: | |
|---|---|---|
| 205 | 961 | PmU.fC.mU.mC.mC.mU.mU.mC.mC.mG.mA.mG.mU.fC.mA.mG.mC.mU.mU-.mU.mG.fA.fC.fU.mC.mG.mG.mA.mA.mG.mG.mA.mG.mA |
| 206 | 962 | PmU.fC.mA.mU.mG.mG.mA.mG.mC.mC.mU.mG.mA.fA.mG.mG.mG.mU.mC.mC.mU-.fU.fC.fA.mG.mG.mC.mU.mC.mC.mA.mU.mG.mA |
| 207 | 963 | PmU.fU.mG.mG.mC.mA.mU.mA.mU.mG.mU.mC.mA.fC.mU.mA.mG.mA.mC.mA.mG.fU.fG.fA.mC-.mA.mU.mA.mU.mG.mC.mC.mA.mA |
| 208 | 964 | PmU.fA.mA.mG.mC.mA.mU.mU.mG.mA.mU.mG.mU.fU.mC.mA.mC.mU.mU.mG.mA.fA.fC.fA-.mU.mC.mA.mA.mU.mG.mC.mU.mU.mA |
| 209 | 965 | PmU.fC.mU.mC.mA.mC.mU.mC.mC.mU.mC.mC.mA.fG.mU.mA.mC.mA.mA.mA.mC.fU.fG.fG-.mA.mG.mG.mA.mG.mU.mG.mA.mG.mA |
| 210 | 966 | PmU.fG.mA.mU.mG.mU.mC.mC.mU.mU.mG.mA.mC.fU.mU.mU.mG.mU.mC.mA.mA.fG.fU.fC.mA-.mA.mG.mG.mA.mC.mA.mU.mC.mA |
| 211 | 967 | PmU.fU.mG.mU.mU.mU.mU.mA.mA.mU.mU.mC.mA.fA.mU.mC.mC.mC.mA.mA.mU.fU.fG.fA.mA-.mU.mU.mA.mA.mA.mA.mC.mA.mA |
| 212 | 968 | PmU.fU.mA.mG.mA.mU.mG.mU.mU.mC.mA.mU.mG.fG.mA.mG.mC.mC.mU.mU.mC.fC.fA.fU.mG-.mA.mA.mC.mA.mU.mC.mU.mA.mA |
| 213 | 969 | PmU.fA.mU.mA.mG.mC.mA.mG.mU.mG.mG.mA.mA.fA.mG.mA.mG.mA.mU.mC.mU.fU.fU.fC.mC-.mA.mC.mU.mG.mC.mU.mA.mU.mA |
| 214 | 970 | PmU.fC.mA.mU.mU.mC.mA.mC.mU.mU.mG.mG.mC.fA.mG.mG.mU.mG.mC.mC.mU.fG.fC.fC.mA-.mA.mG.mU.mG.mA.mA.mU.mG.mA |
| 215 | 971 | PmU.fA.mU.mU.mG.mA.mU.mG.mU.mU.mC.mA.mC.fU.mU.mG.mG.mU.mU.mA.mA.fG.fU.fG.mA-.mA.mC.mA.mU.mC.mA.mA.mU.mA |
| 216 | 972 | PmU.fC.mA.mG.mC.mC.mA.mG.mG.mG.mC.mA.mG.fC.mA.mC.mU.mU.mG-.mU.mG.fC.fU.fG.mC.mC.mC.mU.mG.mG.mC.mU.mG.mA |
| 217 | 973 | PmU.fC.mU.mC.mA.mG.mU.mG.mU.mC.mC.mA.mA.fG.mC.mU.mG.mA.mA.mG.mC.fU.fU.fG.mG-.mA.mC.mA.mC.mU.mG.mA.mG.mA |
| 218 | 974 | PmU.fC.mA.mG.mA.mG.mA.mC.mU.mG.mG.mC.mU.fU.mU.mC.mA.mU.mC.mA.mA.fA.fG.fC.mC-.mA.mG.mU.mC.mU.mC.mU.mG.mA |
| 219 | 975 | PmU.fA.mU.mC.mC.mA.mG.mA.mU.mA.mA.mU.mC.fC.mU.mC.mC.mC.mU.mA.mG.fG.fA.fU.mU-.mA.mU.mC.mU.mG.mG.mA.mU.mA |
| 220 | 976 | PmU.fC.mU.mU.mC.mU.mC.mA.mA.mU.mU.mA.mA.fG.mU.mU.mG.mA.mC.mA.mC.fU.fU.fA.mA-.mU.mU.mG.mA.mG.mA.mA.mG.mA |
| 221 | 977 | PmU.fC.mC.mA.mG.mA.mC.mC.mU.mA.mG.mA.mC.fC.mU.mG.mG.mU.mC.mA.mG.fG.fU.fC.mU-.mA.mG.mG.mU.mC.mU.mG.mG.mA |
| 222 | 978 | PmU.fC.mA.mA.mC.mG.mU.mC.mA.mU.mA.mG.mU.fC.mA.mU.mA.mA.mA.mU.mG.fA.fC.fU.mA-.mU.mG.mA.mC.mG.mU.mU.mG.mA |
| 223 | 979 | PmU.fU.mU.mG.mA.mA.mU.mG.mA.mA.mA.mC.mG.fA.mC.mU.mU.mC.mU.mG.mU.fC.fG.fU.mU-.mU.mC.mA.mU.mU.mC.mA.mA.mA |

TABLE 3-continued

Modified hairpin constructs

| # | SEQ ID NO: | |
|---|---|---|
| 224 | 980 | PmU.fC.mC.mU.mC.mC.mU.mC.mA.mG.mA.mC.mA.fC.mA.mA.mA.mC.mA.mU.mG.fU.fG.fU.mC-.mU.mG.mA.mG.mG.mA.mG.mG.mA |
| 225 | 981 | PmU.fA.mA.mG.mC.mC.mA.mA.mA.mG.mC.mA.mU.fU.mG.mA.mU.mG.mU.mC.mA.fA.fU.fG.mC-.mU.mU.mU.mG.mG.mC.mU.mU.mA |
| 226 | 982 | PmU.fU.mG.mA.mA.mA.mC.mG.mA.mC.mU.mU.mC.fU.mC.mU.mU.mG.mU.mG.mA.fG.fA.fA.mG-.mU.mC.mG.mU.mU.mU.mC.mA.mA |
| 227 | 983 | PmU.fA.mA.mC.mU.mU.mG.mU.mG.mG.mU.mC.mU.fU.mC.mA.mU.mA.mA.mG.mA.fA.fG.fA.m-C.mC.mA.mC.mA.mA.mG.mU.mU.mA |
| 228 | 984 | PmU.fC.mC.mA.mG.mG.mU.mA.mG.mA.mU.mG.mU.fU.mC.mA.mU.mG.mG.mG.mA.fA.fC.fA-.mU.mC.mU.mA.mC.mC.mU.mG.mG.mA |
| 229 | 985 | PmU.fC.mU.mG.mU.mG.mU.mU.mC.mU.mG.mG.mC.fA.mC.mC.mU.mG.mC.mG.mU.fG.fC.fC-.mA.mG.mA.mA.mC.mA.mC.mA.mG.mA |
| 230 | 986 | PmU.fA.mA.mC.mU.mU.mG.mC.mC.mA.mC.mC.mU.fU.mC.mU.mC.mA.mA.mG.mA.fA.fG.fG-.mU.mG.mG.mC.mA.mA.mG.mU.mU.mA |
| 231 | 987 | PmU.fG.mC.mC.mA.mU.mG.mG.mU.mU.mG.mC.mU.fU.mG.mU.mG.mG.mU.mC.mA.fA.fG.fC.mA-.mA.mC.mC.mA.mU.mG.mG.mC.mA |
| 232 | 988 | PmU.fG.mA.mC.mA.mA.mA.mU.mG.mG.mG.mC.mC.fU.mG.mA.mU.mA.mG.mC.mA-.fG.fG.fC.mC.mC.mA.mU.mU.mU.mG.mU.mC.mA |
| 233 | 989 | PmU.fA.mA.mG.mU.mU.mG.mA.mC.mU.mA.mG.mA.fC.mA.mC.mU.mU.mU.mU.mG.fU.fC.fU-.mA.mG.mU.mC.mA.mA.mC.mU.mU.mA |
| 234 | 990 | PmU.fC.mA.mU.mG.mG.mC.mG.mG.mG.mU.mG.mC.fG.mG.mU.mU.mC.mC.mC.mC.fG.fC.fA.m-C.mC.mC.mG.mC.mC.mA.mU.mG.mA |
| 235 | 991 | PmU.fC.mC.mG.mG.mA.mU.mC.mU.mC.mA.mU.mC.fA.mA.mU.mG.mA.mC.mU.mU.fG.fA.fU.mG-.mA.mG.mA.mU.mC.mC.mG.mG.mA |
| 236 | 992 | PmU.fG.mA.mG.mG.mA.mA.mG.mC.mC.mU.mC.mA.fA.mA.mG.mC.mU.mC.mU.mU-.fU.fG.fA.mG.mG.mC.mU.mU.mC.mC.mU.mC.mA |
| 237 | 993 | PmU.fA.mC.mU.mU.mU.mG.mA.mA.mC.mA.mC.mA.fU.mG.mU.mU.mG.mC.mC.mA.fU.fG.fU.mG-.mU.mU.mC.mA.mA.mA.mG.mU.mA |
| 238 | 994 | PmU.fC.mU.mC.mC.mU.mC.mC.mU.mC.mA.mG.mA.fC.mA.mC.mA.mA.mA.mU.mG.fU.fC.fU.mG-.mA.mG.mG.mA.mG.mG.mA.mG.mA |
| 239 | 995 | PmU.fA.mG.mG.mA.mA.mG.mG.mC.mU.mC.mC.mG.fU.mC.mC.mC.mG.mC.mG.mA.fC.fG.fG-.mA.mG.mC.mC.mU.mU.mC.mC.mU.mA |
| 240 | 996 | PmU.fC.mG.mC.mC.mA.mG.mA.mA.mU.mC.mA.mC.fC.mU.mC.mU.mG.mC.mA.mG.fG.fU.fG.mA-.mU.mU.mC.mU.mG.mG.mC.mG.mA |
| 241 | 997 | PmU.fG.mG.mA.mA.mA.mG.mA.mG.mA.mU.mC.mU.fC.mA.mU.mC.mA.mC.mU.mG.fA.fG.fA-.mU.mC.mU.mC.mU.mU.mU.mC.mC.mA |
| 242 | 998 | PmU.fA.mA.mG.mU.mC.mC.mC.mG.mG.mA.mU.mC.fU.mC.mA.mU.mC.mA.mG.mA.fG.fA-.fU.mC.mC.mG.mG.mG.mA.mC.mU.mU.mA |

TABLE 3-continued

| Modified hairpin constructs | | |
|---|---|---|
| # | SEQ ID NO: | |
| 243 | 999 | PmU.fG.mA.mG.mC.mU.mU.mG.mA.mU.mC.mA.mG.fG.mG.mC.mA.mA.mC.mC.mC.fC.fU.fG.mA-.mU.mC. mA.mA.mG.mC.mU.mC.mA |
| 244 | 1000 | PmU.fG.mU.mU.mG.mC.mU.mC.mA.mU.mU.mG.mU.fC.mU.mU.mU.mC.mU.mA.mG.fA.fC.fA.mA-.mU.mG. mA.mG.mC.mA.mA.mC.mA |
| 245 | 1001 | PmU.fU.mG.mC.mU.mU.mG.mU.mG.mG.mU.mA.mA.fU.mC.mG.mG.mU.mA.mG.mA.fU.fU.fA.m-C.mC.mA. mC.mA.mA.mG.mC.mA.mA |
| 246 | 1002 | PmU.fU.mC.mA.mU.mC.mA.mC.mU.mC.mA.mC.mA.fU.mU.mG.mU.mA.mG.mA.mA.fU.fG.fU.mG-.mA.mG. mU.mG.mA.mU.mG.mA.mA |
| 247 | 1003 | PmU.fC.mA.mG.mU.mG.mU.mC.mC.mA.mA.mG.mC.fU.mG.mA.mA.mA.mC.mC.mA.fG.fC.fU-.mU.mG.mG. mA.mC.mA.mC.mU.mG.mA |
| 248 | 1004 | PmU.fC.mC.mA.mU.mU.mC.mU.mU.mG.mA.mU.mG.fU.mA.mG.mA.mC.mC.mU.mA.fC.fA.fU.mC-.mA.mA. mG.mA.mA.mU.mG.mG.mA |
| 249 | 1005 | PmU.fA.mA.mC.mA.mA.mU.mG.mU.mG.mC.mU.mG.fC.mU.mG.mU.mC.mA.mA.mG.fC.fA.fG.mC-.mA.mC. mA.mU.mU.mG.mU.mU.mA |
| 250 | 1006 | PmU.fG.mA.mC.mU.mU.mC.mA.mA.mC.mU.mU.mG.fU.mG.mG.mU.mC.mU.mC.mA.fC.fA.fA.mG-.mU.mU. mG.mA.mA.mG.mU.mC.mA |
| 106-13(4) as + s | 1007 | mU.fU.mG.fA.mA.fU.mG.fA.mA.fA.mC.fG.mA.fC.mU.fU.mC.fU.mC.fG.mU.fU.mU.fC.mA.fU.mU. fC.mA.fA.3xGalNAc |
| 13(5) as + s | 1008 | mU.fU.mG.mC.mC.mA.mC.mA.mG.mA.mG.mA.mC.fU.mC.mA.mG.mA.mG.mA.fG.fU.fC.mU.mC.mU.mG. mU.mG.mG.mC.mA.mA.3xGalNAc |

Note =
Each of the above constructs may or may not have a phosphate modification at the 5' end group. Furthermore, and independently, each of the above constructs may or may not have a "3x GalNAc" coupled to the 3' end group. Advantageously the constructs employ a 3x GalNAc ligand, in particular a toothbrush ligand as defined herein. Particularly advantageous are constructs which in addition have a 5' phosphate, even though this is not a strict requirement, given that in the absence thereof, mammalian cells will add such phosphate in case it is absent from the molecule as administered.

Table 4 below shows constructs "106-13(4) as+s" and "13(5) as +s" with their internucleoside linkages.

TABLE 4

| modified hairpin constructs including internucleoside linkages | | |
|---|---|---|
| # | SEQ ID NO: | |
| 13(5) as + s | 1009 | 5'-usUfsgccacagagacUfscsasgsasgs aGfUfCfucuguggcsasas(SO-GalNAc) (SO-GalNAc)(SO-GalNAc)-3' |
| 106-13(4) as + s | 1010 | 5'-usUfsgAfaUfgAfaAfcGfasCfsusU fscsUfscGfuUfuCfaUfuCfsasAfs(SO-GalNAc)(SO-GalNAc)(SO-GalNAc)-3' |

Notes about the nomenclature in the table:
Nf: 2'-Fluoro residues
n: 2'-O-methyl residues
(invA): inverted ribo-A
(invG): inverted ribo-G
s: phosphorothioate
p: phosphate
(SO-GaNAc): Simaomics mono-GalNAc building block, also referred to as "toothbrush" herein The sequences corresponding to those in the Tables above, where the 5' nucleoside of the antisense (guide) strand (first region as defined in the claims herein) can include any nucleobase that can be present in an RNA molecule, in other words can be any of adenine (A), uracil (U), guanine (G) or cytosine (C). Additionally, the 3' nucleoside of the sense (passenger) strand (second region as defined in the claims herein) can include any nucleobase that can be present in an RNA molecule, in other words can be any of adenine (A), uracil (U), guanine (G) or cytosine (C), advantageously, however, a nucleobase that is complementary to the 5' nucleobase of the antisense (guide) strand (first region as defined herein).

While the methods are shown and described as being a series of acts that are performed in a particular sequence, it is to be understood and appreciated that the methods are not limited by the order of the sequence. For example, some acts can occur in a different order than what is described herein. In addition, an act can occur concurrently with another act. Further, in some instances, not all acts may be required to implement a method described herein.

The order of the steps of the methods described herein is exemplary, but the steps may be carried out in any suitable order, or simultaneously where appropriate. Additionally, steps may be added or substituted in, or individual steps may be deleted from any of the methods without departing from the scope of the subject matter described herein. Aspects of any of the Examples described above may be combined with aspects of any of the other Examples described to form further Examples.

It will be understood that the above description of a specific embodiment is given by way of example only and that various modifications may be made by those skilled in the art. What has been described above includes Examples of one or more embodiments. It is, of course, not possible to describe every conceivable modification and alteration of the above compounds, compositions or methods for purposes of describing the aforementioned aspects, but one of ordinary skill in the art can recognize that many further modifications and permutations of various aspects are possible. Accordingly, the described aspects are intended to embrace all such alterations, modifications, and variations that fall within the scope of the appended claims.

EXAMPLES

The following Examples illustrate certain embodiments of the present disclosure and are not limiting. Moreover, where specific embodiments are provided, the inventors have contemplated generic application of those specific embodiments. For example, disclosure of an oligonucleotide having a particular motif or modification patterns provides reasonable support for additional oligonucleotides having the same or similar motif or modification patterns.

The syntheses of the RNAi constructs disclosed herein have been carried out using synthesis methods known to the person skilled in the art, such as synthesis methods disclosed in https://en.wikipedia.org/wiki/Oligonucleotide_synthesis {retrieved on 16 Feb. 2022}, where the methods disclosed on this website are incorporated by reference herein in their entirety. The only difference to the synthesis method disclosed in this reference is that GalNAc phosphoramidite immobilized on a support is used in the synthesis method during the first synthesis step.

Example 1

Materials and Methods

Cell Culture:

HepG2 (ATCC cat. 85011430) cells were maintained by biweekly passing in EMEM supplemented with 10% FBS, 20 mM L-glutamine, 10 mM HEPES pH 7.2, 1 mM sodium pyruvate, 1×MEM non-essential amino acids, and 1×Pen/Strep (EMEM complete).

CFB Target Identification and Duplex Preparation:

Oligomeric compounds targeting CFB were identified by bioinformatic analysis on human CFB mRNA sequence as given in RefSeq sequence ID NM_001710.5. 250 compounds were selected for synthesis as asymmetric duplexes. Compounds were dissolved to 50 uM in molecular biology grade water and annealed by heating at 95 C for 5 minutes followed by gradual cooling to room temperature.

CFB—Primary Screen:

On the day of transfection, HepG2 cells were collected by trypsinization, counted, and seeded in 96 well tissue culture treated plates at 10,000 cells per well in 50 uL complete EMEM with 20% FBS. Cells were allowed to rest for 4 hours before transfection with 2 pmoles of each respective CFB-targeting oligomeric compound in triplicate via RNAiMax (ThermoFisher). In brief, 8 pmoles of each compound were diluted in 100 uL OptiMEM and mixed gently with 0.8 uL of RNAiMax in 100 uL OptiMEM to make 200 uL total complex. 50 μL of each RNAiMax complexed compound was added to each respective triplicate well of HepG2 cells for a final mixture of 20 nM compound in a volume of 100 μL, 50/50 EMEM/OptiMEM at 10% FBS. 72 hours post transfection, cells were harvested and RNA isolated using the PureLink Pro 96 total RNA Purification Kit (ThermoFisher, 12173011A) according to the manufacturer protocol. Harvested RNA was assayed for CFB expression via Taqman qPCR using the Luna Universal Probe One-Step RT-qPCR Kit (NEB, E3006). Two separate qPCR assays were performed for each sample using two separate CFB Taqman probe sets multiplexed with a common GAPDH VIC probe (ThermoFisher, 4326317E). Thermocycling and data acquisition was performed with an Applied Biosystems QuantStudio 3 Real-Time PCR System.

CFB—Secondary Screen:

Based on data from the primary screen, a yet narrower set of the best performing 30 CFB-targeting constructs were tested in dose curves. As before, HepG2 cells were collected by trypsinization and seeded in 96 well tissue culture plates at 10,000 cells per well in 50 uL complete EMEM with 20% FBS and allowed to rest for 4 hours. Transfection complexes were formed by gently mixing 36 pmoles of each compound in 180 uL OptiMEM with 2.16 uL RNAiMax in 180 uL OptiMEM to make 360 uL total complex. A two fold dilution series was then performed with basal OptiMEM. 50 μL of each dilution was added to respective triplicates of HepG2 cells to make a final dilution series of 50 nM down to 0.32 nM in a volume of 100 μL, 50/50 EMEM/OptiMEM at 10% FBS.

72 hours post transfection, cells were harvested and RNA isolated using the PureLink Pro 96 total RNA Purification Kit (ThermoFisher, 1217301 TA) according to the manufacturer protocol. Harvested RNA was assayed for CFB expression via Taqman qPCR using the Luna Universal Probe One-Step RT-qPCR Kit (NEB, E3006). A single qPCR assay was performed for each sample using CFB Taqman probe set multiplexed with a common GAPDH VIC probe (ThermoFisher, 4326317E). Thermocycling and data acquisition was performed with an Applied Biosystems QuantStudio 3 Real-Time PCR System.

Example 2

Results

Table 5 below shows $IC_{50}$ values (in nM) for 30 specific constructs selected in accordance with the Examples. Max % KD indicates the maximally achieved knock-down with 0% being no knock-down and 100% full knock-down.

| CFB Sequence ID | IC50 | Max % KD |
|---|---|---|
| CFB94 | 4.36 | 83 |
| CFB247 | 4.42 | 84 |
| CFB13 | 5.72 | 93 |
| CFB106 | 5.84 | 88 |
| CFB28 | 6.24 | 84 |
| CFB135 | 6.91 | 89 |
| CFB132 | 6.92 | 87 |
| CFB32 | 6.96 | 81 |
| CFB83 | 7.17 | 88 |
| CFB102 | 7.39 | 83 |
| CFB62 | 7.61 | 90 |
| CFB241 | 7.84 | 82 |
| CFB09 | 8.02 | 92 |
| CFB54 | 8.24 | 82 |
| CFB143 | 8.81 | 82 |
| CFB103 | 9.16 | 80 |
| CFB128 | 9.22 | 83 |
| CFB53 | 9.52 | 83 |
| CFB150 | 10.33 | 83 |
| CFB82 | 10.34 | 88 |
| CFB36 | 10.64 | 79 |

-continued

| CFB Sequence ID | IC50 | Max % KD |
|---|---|---|
| CFB25 | 10.88 | 81 |
| CFB71 | 11.47 | 84 |
| CFB17 | 11.60 | 77 |
| CFB05 | 12.67 | 75 |
| CFB141 | 13.37 | 77 |
| CFB90 | 13.78 | 85 |
| CFB127 | 14.04 | 73 |
| CFB75 | 16.45 | 69 |
| CFB95 | 19.25 | 72 |

The $IC_{50}$ data in the single- to low double-digit nanomolar range demonstrate outstanding performance of numerous constructs as described herein.

Example 3

Materials and Methods

Cell Culture:

Human primary hepatocytes (5 donor pooled—Sekisui XenoTech, HPCH05+) were thawed immediately prior to experimentation and cultured in 1× complete Williams medium (Gibco, A1217601) supplemented with Hepatocytes plating supplement pack (Gibco, CM3000). FBS concentration was modified from manufacture recipe to a final 2.5% (as opposed to 5%) for compound stability.

1× Complete WEM: 2.5% FBS, 1 μM Dexamethasone, Pen/Strep (100 U/mL/100 μg/mL), 4 μg/ml Human Insulin, 2 mM GlutaMAX, 15 mM HEPES, pH 7.4.

Hepatocytes were plated on Collagen I (rat tail) coated 96 well tissue culture plates (Gibco, A1 142803).

CFB Compound Preparation:

Compounds were dissolved to 200 μM in water and annealed by heating at 95 C for 5 minutes followed by rapid cooling on ice.

CFB Compound Transfections:

On the day of transfection, primary human hepatocytes were thawed in 45 mL of human OptiThaw (Sekisui XenoTech, K8000) and centrifuged down at 200 g for 5 minutes. Cells were resuspended in 2× complete WEM and counted. Cell were then plated in 50 μL of 2× complete WEM at 25,000 cells per well on 96 well type 1 rat tail Collagen plates and allowed to rest and attach for four hours before transfection.

Compounds were diluted further to 2 μM in basal WEM. A seven step, five fold dilution series was prepared in basal WEM from 2 μM to 0.000128 μM. 50 μL of each dilution was added to respective triplicates of the plated hepatocytes for a final dilution series of 1 μM down to 0.000064 μM in a volume of 100 uL 1× complete WEM.

72 hours post transfection, cells were harvested and RNA isolated using the PureLink Pro 96 total RNA Purification Kit (ThermoFisher, 12173011A) according to the manufacturer protocol. Harvested RNA was assayed for CFB expression via TaqMan qPCR using the Luna Universal Probe One-Step RT-qPCR Kit (NEB, E3006). A single qPCR assay was performed for each sample using an CFB TaqMan probe set (Hs01011282_g1-FAM) multiplexed with a common GAPDH VIC probe (ThermoFisher, 4326317E). Thermocycling and data acquisition was performed with an Applied Biosystems QuantStudio 3/5 Real-Time PCR System.

Results

The results of the in vitro studies of this example are shown in FIG. 1.

Example 4

Pharmacodynamics Study of STP144G Following Single/Repeat Subcutaneous Injection to Non-Naïve Cynomolgus Monkeys.

Study Protocol

The following study protocol has been drafted before the animal experiments and studies have been completed and therefore uses the future tense. However, as the study has already been completely carried out, each usage of "future tense" shall be considered as the "past tense" in the following description of the study protocol.

TABLE 6

Study Design

| Group | # of Males | Test Article | Target Dose Level (mg/animal) | TOTAL Target Dose Volume (mL) | Target Dose Concentration (mg/mL) | Dose Route |
|---|---|---|---|---|---|---|
| 1 | 4 non-naïve | saline | — | 3.0 mL | — | SC |
| 2 | 4 non-naïve | STP144G (106-13(4)) | 2.5 (Target as 1 mg/kg) | 3.0 mL | 1 | SC |
| 3 | 4 non-naïve | STP144G (106-13(4)) | 7.5 (Target as 3 mg/kg) | 3.0 mL | 3 | SC |
| 4 | 4 non-naïve | STP144G (106-13(4)) | 25 (Target as 10 mg/kg) | 3.0 mL | 10 | SC |
| 5 | 4 non-naïve | STP144G (106-13(4)) | 7.5 (Target as 3 mg/kg) | 3.0 mL | 3 | SC |
| 6 | 4 non-naïve | STP144G (13-5) | 2.5 (Target as 1 mg/kg) | 3.0 mL | 1 | SC |
| 7 | 4 non-naïve | STP144G (13-5) | 7.5 (Target as 3 mg/kg) | 3.0 mL | 3 | SC |
| 8 | 4 non-naïve | STP144G (13-5) | 25 (Target as 10 mg/kg) | 3.0 mL | 10 | SC |
| 9 | 4 non-naïve | STP144G (13-5) | 7.5 (Target as 3 mg/kg) | 3.0 mL | 3 | SC |

Note:
1. Test article storage: at 4° C., protected from light (DO NOT FREEZE the test article)
2. For all groups, animals will be fed on daily diet.
3. For all groups, saline will be used for vehicles

TABLE 7

Dose and Sample Collections

| | Group | Day −7 | Day 0 | Wk 1 | Wk 2 | Wk 3 | Wk 4 | Wk 5 | Wk 6 | Wk 7 | Wk 8 | Wk 9 | Wk 10 | Wk 11 | Wk 12 | Wk 13 |
|---|---|---|---|---|---|---|---|---|---|---|---|---|---|---|---|---|
| Dose | 1 | | QD | | | | | | | | | | | | | |
| | 2 | | QD | | | | | | | | | | | | | |
| | 3 | | QD | | | | | | | | | | | | | |
| | 4 | | QD | | | | | | | | | | | | | |
| | 5 | | QD | QD | QD | | | | | | | | | | | |
| | 6 | | QD | | | | | | | | | | | | | |
| | 7 | | QD | | | | | | | | | | | | | |
| | 8 | | QD | | | | | | | | | | | | | |
| | 9 | | QD | QD | QD | | | | | | | | | | | |
| Clinical Pathology [a] | 1-9 | BI, Se | | BI, Se | BI, Se | BI, Se | BI, Se | | BI, Se | | BI, Se | | BI, Se | | | BI, Se |
| Pharmaco-dynamics [b] | 1-9 | P, Se | P, Se | P, Se | P, Se | P, Se | P, Se | P, Se | P, Se | P, Se | P, Se | P, Se | P, Se | P, Se | P, Se | P, Se |

1. Wk 1 point should be 7 days after Day 0; Wk 2 point should be 14 days after Day 0.

2. Single dose with single compound, subcutaneous injection. For Day 0, Wk 1, and Wk 2, animals will be dosed after all sample collections.

[a] Blood samples collected for clinical pathology will be 2.0 mL in (K2)EDTA anticoagulant for hematology and 1.4 mL in a plain tube (no anticoagulant) for serum chemistry as indicated in Section 4.1.3.

[b] Blood samples collected for pharmacodynamics will be 2 mL in K2EDTA for Complement Factor B and 2 mL in a plain tube (no anticoagulant) as indicated in Section 4.1.4.

1 Study Information 1.1 Study Objective

The objective of this study is to determine the pharmacodynamics (PD) of STP144G following a single/repeat subcutaneous (SC) administration in male cynomolgus monkeys.

1.2 Regulatory Compliance

This study will be conducted at WuXi AppTec Co., Ltd., (hereafter WuXi) and in accordance with the WuXi Institutional Animal Care and Use Committee (IACUC) standard animal procedures along with the IACUC guidelines that are in compliance with the Animal Welfare Act and the Guide for the Care and Use of Laboratory Animals.

This study will be conducted in accordance with this protocol and protocol amendments (if applicable) and the associated study-specific procedures, and with applicable WuXi Standard Operating Procedures (SOPs) and generally recognized good laboratory practices. This study will not be considered within the scope of the Good Laboratory Practice regulations.

Test Article and Vehicle Information

TABLE 8

| | | | | | | | |
|---|---|---|---|---|---|---|---|
| | | | Test Article | | | | |
| Test Article | Lot/Batch Number | Molecular Weight of Free Base | Molecular Weight of Salt | Salt Factor | Chemical Formula | Purity (%) | Storage |
| STP144G (106-13(4) as + s) | K1 | Refer to product CoA | Refer to product CoA | Refer to product CoA | Refer to product CoA | 83% | 4 C. |
| STP144G (13-5 as + s) | K1 | Refer to product CoA | Refer to product CoA | Refer to product CoA | Refer to product CoA | 83% | 4 C. |

*Free base

NA = Not applicable

Storage Conditions: Store at 4 C. (DO NOT FREEZE the test article), protected from light Handling Instructions: Standard laboratory precautions as defined in WuXi SOPs Dose Preparation: Doses will be prepared according to instructions provided by the sponsor. A copy of the instructions, as well as details of preparation, will be maintained in the study records.

Disposition of Remaining Test Article Formulations: Remaining formulations will be stored at 4° C.

Disposition of Remaining Test Article (dry powder or solid): Remaining test article will be shipped back to sponsor or discarded 6 months after the final report is signed or at approval of Sponsor.

2.2 Negative Control and Vehicle

The vehicles will be prepared at WuXi AppTec Co. Details will be documented in the raw data.

2.3 Formulation Preparation

Ready-to-inject formulations will be provided by Sirnaomics.

Test System Identification 3.1 Animal Specifications

| | |
|---|---|
| Species | Cynomolgus monkeys (*Macaca fascicularis*) |
| Justification for Species Selection | This is an acceptable species to support PD studies for compounds intended to use in humans. |
| History of Dosing | 36 non-naïve animals |
| Body Weight Range | 2.5 kg in average |
| Age | 2.0-3.0 years old |
| Sex | Male |
| Source | Hainan Jingang Laboratory Animal Co. Ltd and other permitted vendor |
| Address of Supplier | Nayangxintan Fucheng Town, Qiongshan District, Haikou Hainan Province, P.R. China |
| Method of Identification | Unique skin tattoo on chest |
| Justification for number of Animals | The number of animals in each group is the minimum number of animals necessary for assessment of interanimal variability. |
| Selection of Animals | 45 males will be selected from available WuXi stock animals. Animals will have undergone a physical examination for general health by a staff veterinarian. 36 males confirmed as being healthy will be assigned to study. |
| Acclimation Period | Selected animals will be acclimated at the WuXi testing facility prior to the study. |

3.2 Animal Care 3.2.1 Environmental Conditions

The room(s) will be controlled and monitored for relative humidity (targeted mean range 40% to 70%, and any excursion from this range for more than 3 hours will be documented as a deviation) and temperature (targeted mean range 18° C. to 26° C., and any excursion from this range will be documented as a deviation) with 10 to 20 air changes/hour. The room will be on a 12-hour light/dark cycle except when interruptions are necessitated by study activities.

3.2.2 Housing

Animals will be pair-housed in cages that are in accordance with applicable animal welfare laws and regulations during acclimation period. The monkeys will be housed individually in cages during experiment.

Diet and Feeding

Animals will be fed twice daily. Stock monkeys will be fed approximately 120 grams of Certified Monkey Diet daily. These amounts can be adjusted as necessary based on food consumption of the group or body weight changes of an individual and/or changes in the certified diet.

Animals will be fasted overnight prior to blood collections for serum chemistry.

Administration of Dose Formulation

Figure 2:
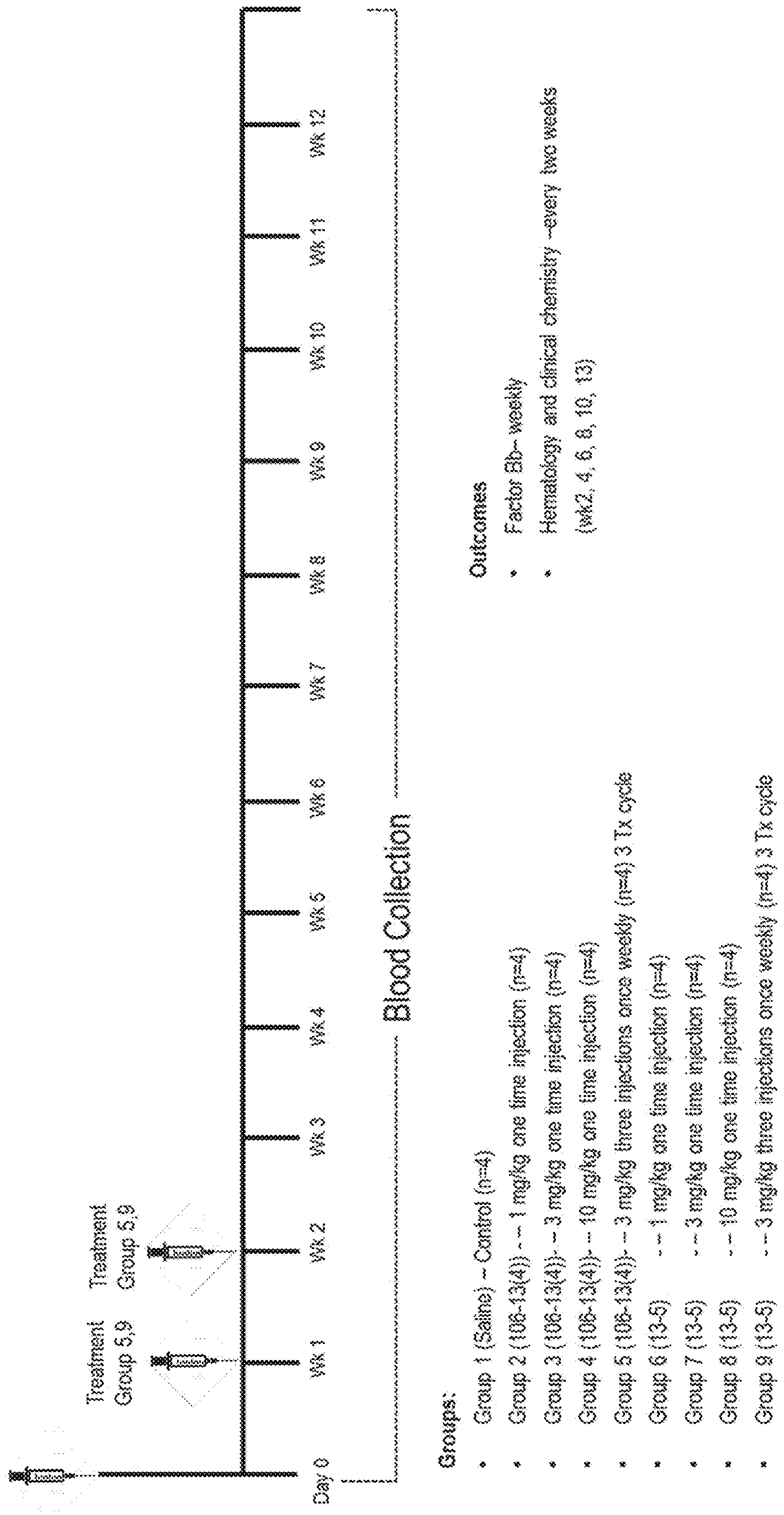
FIG. 2 shows a study design including a time line with the time points of applying the dose to the Non-Human Primates (NHP) and time points for taking samples.

For the administration schedule and sampling also see FIG. 2

| | |
|---|---|
| Administration Route: | Subcutaneous injection via the dorsal area of the animals' thoracic regions. |
| Justification for the Dose Level: | Dose levels chosen to characterize the pharmacodynamics of test article in monkeys over the desired dose range and dosing frequencies. |
| Justification for the Administration Route: | This administration route is consistent with the proposed initial route of human administration. |
| Dose Administration: | The dose formulations will be administered per facility SOPs. SC ADMINISTRATION: SC injection site will be along the dorsal area of the animals' thoracic regions. When the injection site is altered, the location must be documented in the record. |

Drinking Water

Reverse osmosis (RO) water will be available to all animals, ad libitum.

3.2.3 Feed and Water Analyses

RO water is analyzed every three months and every batch of feed will be analyzed before use.

Feed and water analyses will be maintained in the facility records.

3.2.4 Environmental Enrichment

Enrichment toys will be provided.

4.1 Observations and Examinations 4.1.1 Clinical Observations

Twice daily (approximately 9:30 a.m. and 4:00 p.m.), cage-side observations for general health and appearance will be conducted. Animals will be given physical examinations prior to study initiation to confirm animals' health. On dosing days, the animals will be observed at 2, 4 and 6-hours post-dosing. General condition, injection site, behavior, activity, excretion, respiration, or other unusual observations noted throughout the study will be recorded in the raw data. When necessary, additional clinical observations will be performed and recorded. A staff veterinarian or veterinary technician will evaluate each animal if clinical observations demonstrate declining animal condition and the Study Director will be notified. The Study Director, or designee, will notify the Sponsor if warranted by the evaluation.

4.1.2 Body Weight

All animals will be weighed weekly. On dosing days, animals will be weighed prior to dosing.

4.1.3 Blood Collection for Clinical Pathology

All blood samples will be collected from a peripheral vessel from restrained, non-sedated animals.

TABLE 9

Clinical Pathology Schedule

| Groups | Sample | Sampling Schedule[a] | Evaluations | Tube Type/Size Information | | Sample Volume approximately (minimum) |
|---|---|---|---|---|---|---|
| 1-9 | Blood | Once during | Hematology | $K_2EDTA$ | 2 mL | 2.0 mL (1.0 mL) |
| | | pre-study | Clinical | Plain with | 1.4 mL | 0.7 mL (0.6 mL) |

TABLE 9-continued

| Clinical Pathology Schedule | | | | | |
|---|---|---|---|---|---|
| Groups | Sample | Sampling Schedule[a] | Evaluations | Tube Type/Size Information | Sample Volume approximately (minimum) |
| | | (Day −16); Weeks 1, 2, 3, 4, 6, 8, 10, 13. | Chemistry | separating gel | |

[a]Blood sample may be collected from animals subjected to unscheduled euthanasia. Animals may not be fasted under that circumstance.

(1) Blood Collection for Hematology: Whole blood (at least 1.0 mL) will be collected from the animals into commercially available tubes with Potassium (K2) EDTA at room temperature (RT). The blood samples will be sent to clinical pathology lab in RT and tested for hematology parameters listed in the Table 8.

Erythrocyte count (RBC), Red cell distribution width (RDW), Hematocrit (HCT), Platelet count (PLT), Hemoglobin (HGB), Mean platelet volume (MPV), Mean corpuscular volume (MCV), Leukocyte counts (WBC), and Differential (absolute and percent), Mean corpuscular hemoglobin (MCH), Blood smear for possible cytology, Mean corpuscular hemoglobin concentration (MCHC), Absolute reticulocyte count (Retic), Hemoglobin Concentration Distribution Width (HDW) and Platelet Distribution Width (PDW)

A blood smear will be prepared from each hematology sample. Blood smears will be labeled, stained, and stored. Blood smears may be read to investigate results of the hematology analyses. If additional examination of blood smears is deemed necessary, the smears may be evaluated subsequently and this evaluation will be described in a study plan amendment.

(2) Blood Collection for Clinical Chemistry: Whole blood samples (approximately 1.4 mL) without anticoagulant will be collected into commercially available plain tubes with separating gel, held at RT up-right for at least 30 minutes, and sent to clinical pathology lab. The samples will be processed to serum, which will be examined for the parameters listed in Table 8. Alkaline Phosphatase (ALP), Total Protein (TP), Alanine Aminotransferase (ALT), Albumin (ALB), Aspartate Aminotransferase (AST), g-glutamyltransferase (GGT), Bilirubin, total (TBIL), Globulin (GLB), Phosphorus (P), Albumin/Globulin Ratio Creatinine (CRE), Sodium (Na), Glucose (GLU), Chloride (Cl), Calcium (Ca), Triglycerides (TG), Total Cholesterol (TCHO), Urea (UREA), Potassium (K), Creatine Kinase (CK), Lactate Dehydrogenase (LDH), Glutamate dehydrogenase (GLDH)

4.1.4 Blood Collection for Pharmacodynamics (PD)

Blood: All blood samples will be collected from a peripheral vessel from restrained, non-sedated animals.

Animals: All available, all groups

TABLE 10

| Pharmacodynamics Schedule | | | | | | |
|---|---|---|---|---|---|---|
| Groups | Sample | Sampling Schedule[a] | Evaluations | Tube Type/Size Information | | Sample Volume approximately (minimum) |
| 1-9 | Blood | Once during pre-study (Day −16); Day 1, and weekly thereafter. | CFB ELISA Serum | $K_2$EDTA Plain with separating gel | 2 mL 3 mL | 1.5 mL (1.0 mL) 1.5 mL (1.3 mL) |

[a]Blood sample may be collected from animals subjected to unscheduled euthanasia. Animals may not be fasted under that circumstance.

Post-Dose

Blood volume: Approximately 5.0 mL total

Frequency: Refer to Table 8. Actual sample collection times will be recorded in the study records. For samples collected within the first hour of dosing, a ±1 minute is acceptable. For the remaining time points, samples that are taken within 5% of the scheduled time are acceptable and will not be considered as protocol deviation.

Sample Processing: For CFB ELISA: 2 mL Blood will be collected into a tube (Purchased from sponsor's required company) containing $K_2EDTA$ on wet ice. Then all the blood will be mixed upside down 4 times. Samples will be centrifuged (1000 g for 20 minutes at 4° C.) and approximately 1 mL plasma will be transferred into two tubes quickly (approximately 0.50 mL per tube). All tubes should be flash frozen, and then stored at −80° C. until shipped to WuXi SH site (on dry ice), ATTN: Zhang Ronghua (zhang_ronghua@wuxiapptec.com) for analysis of CFB protein by ELISA or stored as back up.

For Serum: Whole blood samples (approximately 3.0 mL) without anticoagulant will be collected in serum separator tubes. Invert the tubes gently 4 times. Then held at RT and up-right for 30 minutes, to allow clotting, and then samples will be centrifuged (3200 g for 10 minutes at 4° C.) and approximately 1.5 mL serum will be transferred into three tubes quickly (approximately 0.50 mL per tube). one will be shipped to WuXi SH site (on dry ice), ATTN: Zhang Ronghua (zhang_ronghua@wuxiapptec.com) for analysis of CFB protein by ELISA under 4C. other two tubes should be flash frozen, and then stored at −80° C. as back up.

Protocol Amendments and Deviations

Changes to the approved protocol will be in the form of amendments approved by the Study Director and the Sponsor. Amendments will describe the protocol changes clearly and will include the effective date of the change and the justification for the change. The Study Director and Sponsor Representative may authorize protocol changes by telephone or electronic means if he/she is not physically present at the time urgent or critical changes are required. Any authorization for such changes made as above must be documented appropriately and followed by a properly prepared written protocol amendment. The amendment must be signed and dated by the Study Director within 45 days of the effective date(s).

All deviations from the protocol and SOPs and the reasons of the deviations will be documented and acknowledged by the Study Director. The Sponsor Representative will be informed promptly of the occurrence of any deviations that might affect the results of the study, and any corrective actions taken. Protocol and SOP deviations that could impact data interpretation will be included in the final report.

Archiving of Materials

Test article preparation, test article tracking, in-life data, protocol, protocol amendments (if applicable), and the original final report generated as a result of this study will be archived at WuXi AppTec, Wuzhong District, Suzhou, Jiangsu Province 215104, P.R. China. WuXi AppTec will be responsible for archiving any raw data generated as a result of this study and the storage life should be at least 2 years following the date on which the study is completed.

Statistical Analysis

The following section does not apply to data recorded on unscheduled occasions. Such data will be reported on an individual basis.

All numerical data (except those that are collected directly and analyzed by Provantis) will be subjected to calculation of group means and standard deviations by using Microsoft Excel software, unless otherwise stated hereafter. These descriptive statistics will be presented for each dataset of interest, as determined by the variable to be analyzed and the dataset classification variables (for example: sex, measurement occasion, and any other relevant variable that can be used to specify on which subdivision the descriptive statistics have to be reported).

If a dataset has fewer than three non-missing values in each group, then the following inferential data analysis will not be conducted.

Whenever there are more than two groups, the homogeneity of the group variances will be evaluated using Levene's test at the 0.05 significance level. If differences between group variances are not found to be significant ($p>0.05$), then a parametric one-way analysis of variance (ANOVA) will be performed. When significant differences among the means are indicated by ANOVA test ($p\leq 0.05$), Dunnett's test will be used to perform the group mean comparisons between the control group and each treated group.

If Levene's test indicates heterogeneous group variances ($p\leq 0.05$) and the data set contains just positive values, log transformation will be performed. If transformed data still fail the test for homogeneity of variance ($p\leq 0.05$) or where the data contain zero and/or negative values, then the non-parametric Kruskal-Wallis test will be used to compare all considered groups. When Kruskal-Wallis test is significant ($p\leq 0.05$), Dunnett's test on ranks will be used to perform the pairwise group comparisons of interest.

Whenever there are only two groups to compare, Levene's test will be performed as described above but a two-sample t-test will replace the one-way ANOVA, a Wilcoxon rank-sum test will be performed instead of the Kruskal-Wallis and, no Dunnett's tests or Dunnett's tests on ranks will be performed.

Each pairwise group comparisons of interest will be conducted via a two-sided test at the 5% significance level. Significant results will be reported as either $p\leq 0.001$, $p\leq 0.01$, or $p\leq 0.05$, where p represents the observed probability.

Results

Figure 3A:
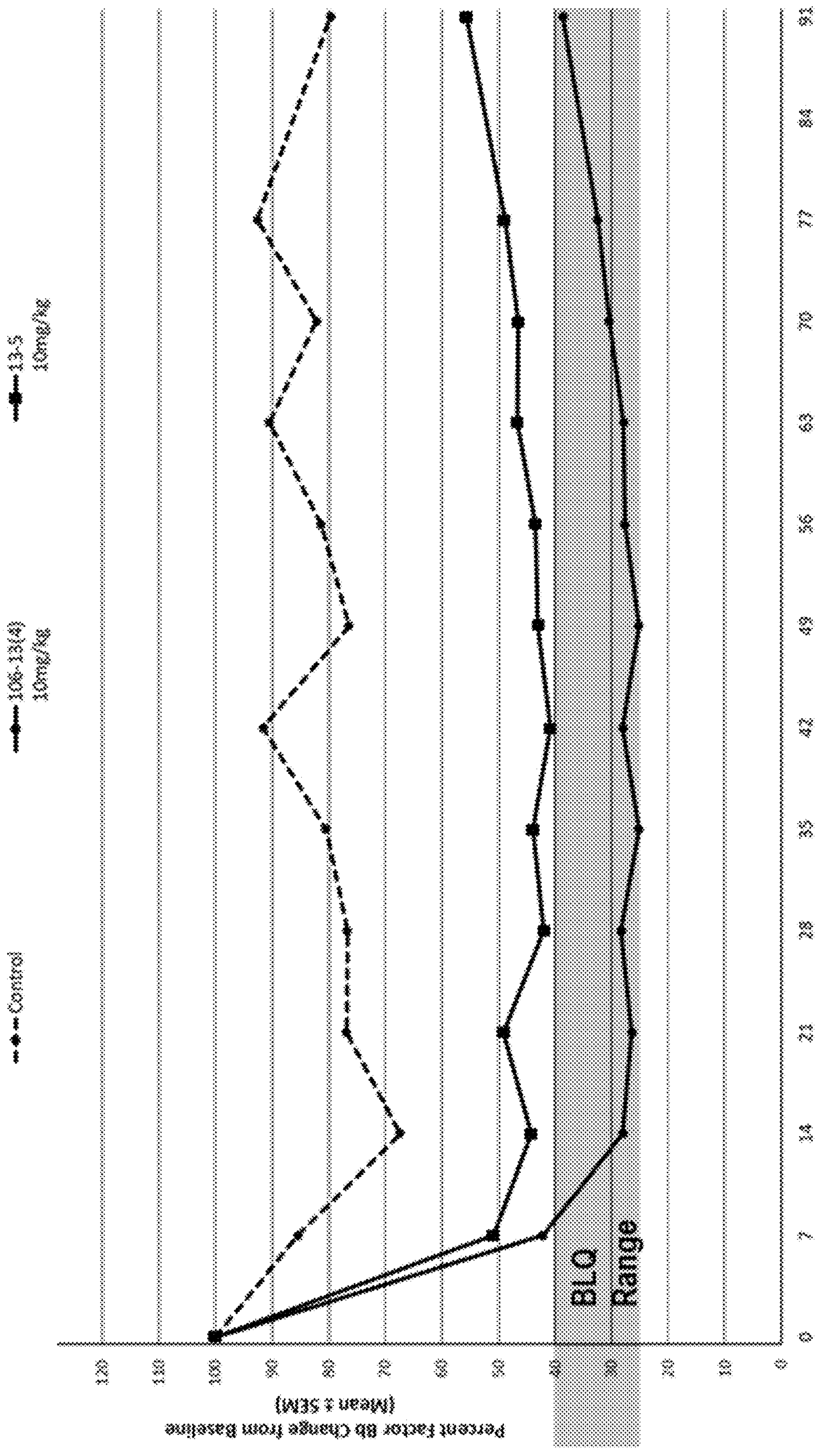
FIG. 3*a* shows a Mean Percent of remaining factor Bb (an established read-out for CFB down-regulation and complement pathway down-regulation) levels in the plasma for a single treatment oligomeric with the inventive oligomeric constructs 106-13(4) or 13(5).

Max reduction of Factor Bb and duration of response (see FIG. 3*a*):

106-13(4)
- Max suppression of 74% at week 5
- 60% reduction from week 2 to week 13
- Mean BLQ from week 2 to week 10

Figure 3B:
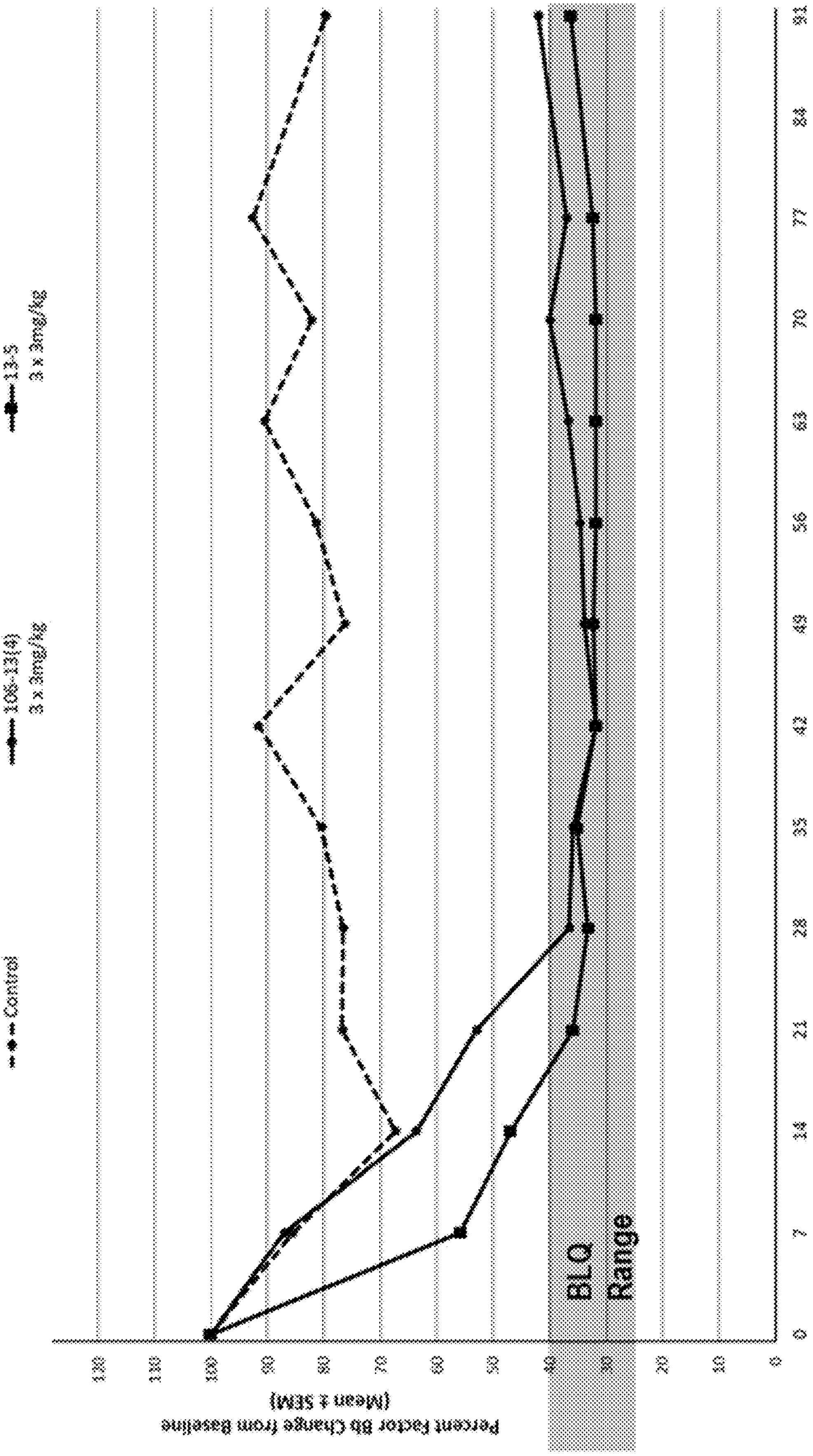
FIG. 3*b* shows a Mean Percent of remaining factor Bb levels in the plasma for a multiple treatment with the inventive oligomeric constructs 106-13(4) or 13(5).
Figure 4A:
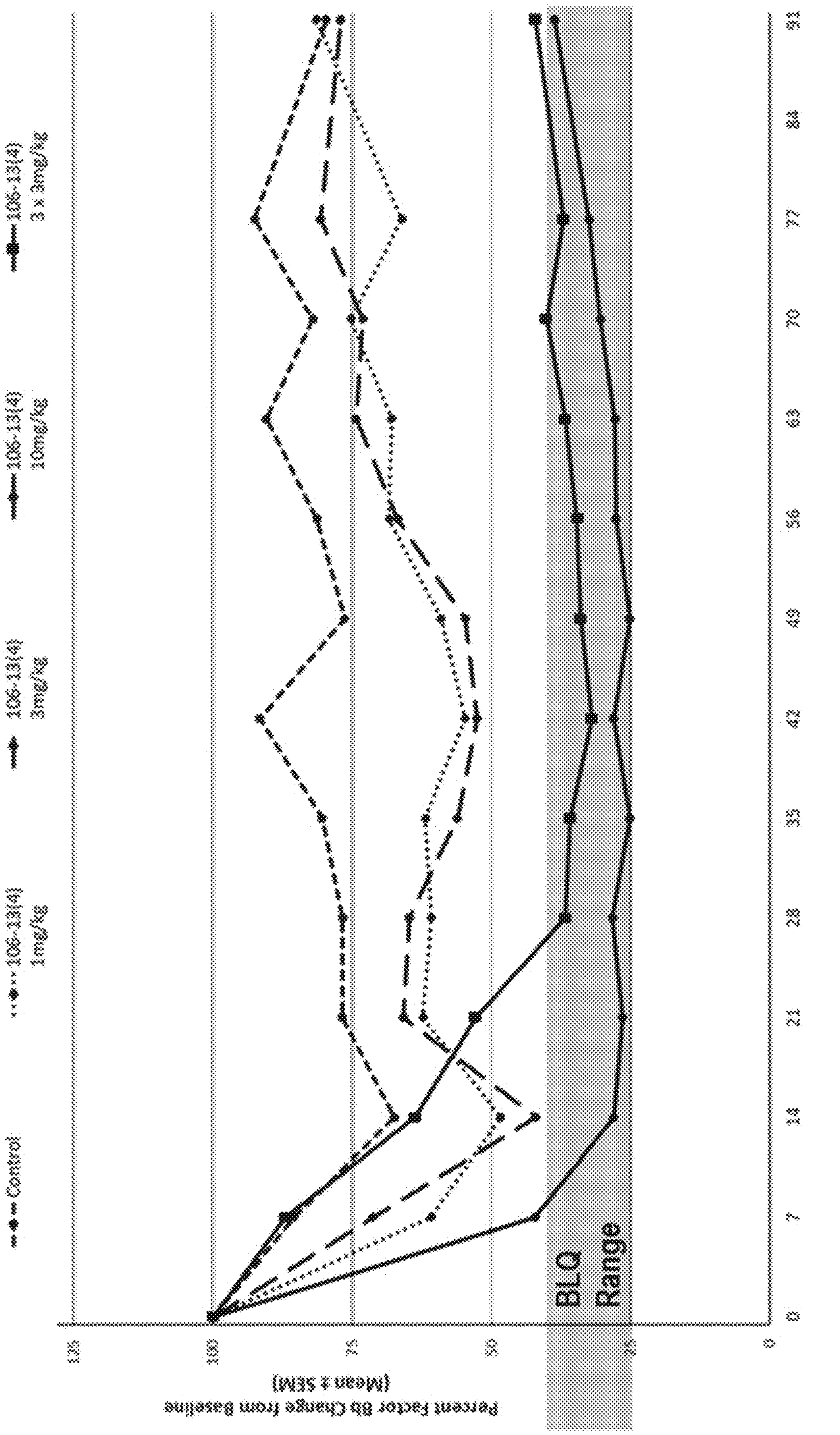
FIG. 4*a* shows a Mean Percent of remaining factor Bb levels in the plasma for groups treated with the inventive oligomeric construct 106-13(4) in comparison with the control group.
Figure 4B:
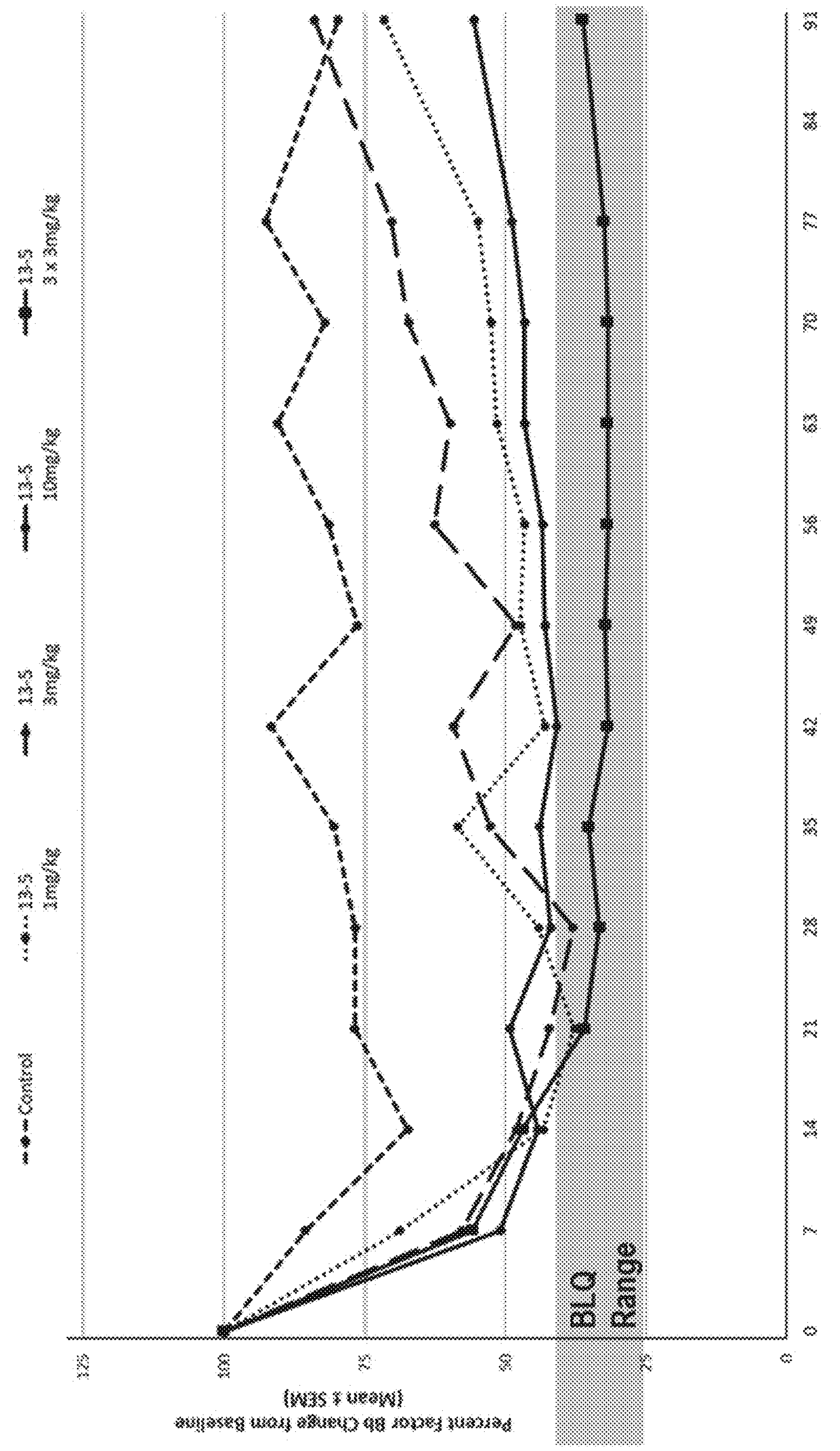
FIG. 4*b* shows shows a Mean Percent of remaining factor Bb levels in the plasma for groups treated with the inventive oligomeric construct 13(5) in comparison with the control group.

13-5
- Max suppression of 59% at week 6
- 50% reduction from week 2 to week 13
- No Mean BLQ for any of the timepoints Max reduction of Factor Bb and duration of response (see FIG. 3*b*):

106-13(4)
- Max suppression of 68% at week 6
- 50% reduction from week 4 to week 13
- Mean BLQ at week 6

13-5
- Max suppression of 68% at week 6
- 50% reduction from week 2 to week 13
- Mean BLQ from week 6 to week 11

Example 5

Dose Response and Duration Response In Vivo in a Humanized Liver Mouse Model

The purpose of this study is to evaluate a dose- and duration-response effect of selected candidate leads for GalNAc-siRNA constructs targeting Complement Factor B (CFB) in a humanized liver UPA-SCID mouse model. Test articles will be administered via subcutaneous administration and evaluated at 14 and 42 days post-dose. Endpoints will include the collection of liver punch biopsies, and the collection of serum and plasma samples for the evaluation of Factor Bb and CFB activity in the Factor Bb ELISA and hemolytic assay, respectively.

Materials and Methods

Test and Control Articles

| Vehicle: Phosphate Buffered Saline (PBS) | |
|---|---|
| Identification | PBS |
| Description | Vehicle |
| Appearance | Clear solution |
| CAS Number | N/A |
| Manufacturer/Supplier | Will be documented in study records and final report |
| Storage Conditions | Ambient |
| Catalog Number | Will be documented in study records and final report |
| Lot/Batch Number | Will be documented in study records and final report |
| Expiration/Retest Date | Will be documented in study records and final report |
| Sterility | Sterile |
| Purity | Will be documented in study records and final report |
| pH | Will be documented in study records and final report |
| Dose Concentration | 0 mg/kg |
| Dose Volume | 200 μL fixed volume |
| Route | Subcutaneous injection |
| Dosing Frequency | Once on Day 0 |
| Dose Preparation | N/A |

| Test Article: CFB mxRNA #13-5 | |
|---|---|
| Identification | CFB - 13-5 |
| Description | GalNAc-siRNA targeting Complement Factor B |
| Appearance | Clear liquid |
| CAS Number | N/A |
| Manufacturer/Supplier | RiboBio |
| Storage Conditions | 4° C. |
| Lot/Batch Number | N/A |
| Expiration/Retest Date | N/A |
| Sterility | <1 EU/mg |
| Purity | >80% |
| pH | N/A |
| Dose Levels | 10 and 30 mg/kg (approximated - fixed volumed will be administered) |
| Dose Volume | 200 μL fixed volume |
| Dose Concentrations | N/A |
| Route | Subcutaneous injection in scruff (Note: that the injection must be given subcutaneously. The test articles will not be functional if the subcutaneous site is missed, and injection is given within the muscular region or test articles are injected into the vein/bloodstream) |
| Dosing Frequency | Once on Day 0 |
| Dose Preparation | Ready to inject solutions will be provided |

| Test Article: CFB mxRNA #106-13(4) | |
|---|---|
| Identification | CFB - 13-5 |
| Description | GalNAc-siRNA targeting Complement Factor B |
| Appearance | Clear liquid |
| CAS Number | N/A |
| Manufacturer/Supplier | RiboBio |
| Storage Conditions | 4° C. |
| Lot/Batch Number | N/A |
| Expiration/Retest Date | N/A |
| Sterility | <1 EU/mg |
| Purity | >80% |
| pH | N/A |
| Dose Levels | 10 and 30 mg/kg (approximated - fixed volumed will be administered) |
| Dose Volume | 200 μL fixed volume |
| Dose Concentrations | N/A |
| Route | Subcutaneous injection in scruff (Note: that the injection must be given subcutaneously. The test articles will not be functional if the subcutaneous site is missed, and injection is given within the muscular region or test articles are injected into the vein/bloodstream) |
| Dosing Frequency | Once on Day 0 |
| Dose Preparation | Ready to inject solutions will be provided |

Dose Formulation

No preparation is required for the test material as it will be received as ready-to-dose formulations.

Identification of Test and Control Articles

All test article, positive control, and vehicle control storage containers will be labeled at a minimum with identification (including lot/batch number, if available), storage conditions, and expiration/retest date, if available.

Test System

Justification of Test System

Humanized liver uPA-SCID mice are reported to have up to 95% human hepatocyte engraftment; normal human liver histology and function; human-specific metabolism and excretion pathways; expression of human genes, mRNA, and proteins; human-like lipid profiles, production of human albumin and human-like biliary excretion, and a wide range of research applications. Thus, humanized liver uPA-SCID mice are an ideal test system for the evaluation of therapeutics that involve CFB targets as CFB is produced in the liver.

Animals

Female humanized liver uPA-SCID mice (approximately 22-24 weeks old) were acclimated at least 7 days prior to use. Only animals in good health prior to dosing will be assigned to the study. The animals will be monitored daily for the appearance of local or systemic toxicity. All animals will be housed in clean room and animal handling will be performed in a sterilized biological safety cabinet by trained personnel wearing appropriately disinfected personal protective equipment.

Methodology

Study Outline

On Day 0, all study animals will be dosed by subcutaneous injection according to the Study Outline below. Clinical observations will be recorded daily. The study design will require 32 female mice (4 mice per treatment group, plus 2 extra mice). On Day 14, 4 vehicle animals (Group 1A), 8 CFB mxRNA #13-5 animals (Groups 2A and 2B), and 8 CFB mxRNA #106-13(4) animals (Groups 3A and 3B) will be euthanized. On Day 42, 4 CFB mxRNA #13-5 animals (Group 2C), and 4 CFB mxRNA #106-13(4) animals (Group 3C) will be euthanized. At each timepoint, terminal blood collections for serum and plasma, liver punch biopsies, and the collection of remaining liver tissue will be performed.

| Study Outline[1] | | | |
|---|---|---|---|
| Terminal Timepoint | Control (PBS) | CFB mxRNA #13-5 | CFB mxRNA #106-13(4) |
| Day 14 | Group 1A | Group 2A (10 mg/kg) | Group 3A (10 mg/kg) |
| | | Group 2B (30 mg/kg) | Group 3B (30 mg/kg) |
| Day 42 (Week 6) | Group 1B | Group 2C (10 mg/kg) | Group 3C (10 mg/kg) |

[1]n = 4/group. Two extra mice will serve as replacements due to health conditions or body weight outliers.

Body Weights

Body weights will be collected at receipt (for general health assessment), on Day −1, and at terminal timepoints prior to euthanasia.

Dosing (Day 0)

On Day 0, all mice will be injected subcutaneously with vehicle or test article per the Study Outline Table. Each animal will be injected subcutaneously in scruff with an injection volume of 200 uL.

Daily Observations

All animals will be observed at least once daily for clinical signs. As humanized mice are predisposed to opportunistic infection due to compromised immune function. Staff will monitor mice for clinical signs that may indicate infection, including ruffled fur and hunched posture that become more pronounced beyond the slightly ruffled fur and hunched posture that exists at baseline, and decreased activity. Common infections to be aware of in these mice include: infected skin wounds, cellulitis, abscesses (skin and internal organs), otitis media, conjunctivitis, panophthalmitis, and localized and widespread infections involving liver, heart, lungs, uterus, accessory sex glands. While not indicative of infection, abdominal distension (related to liver tissue engraftment) may be observed and if observed, will be noted.

Unscheduled Deaths and Moribund Animals

Moribund animals displaying severe effects will be discussed with the veterinarian or euthanized at the veterinarian's and Study Director's recommendation. Animals will be monitored with an increased frequency (up to twice daily; at least 5 hours between observations) if adverse clinical signs are observed, including mortality of other animals on study. Abnormal findings will be recorded as they are observed.

Samples will be collected from animals found dead and carcasses will be discarded without further evaluation.

Terminal Procedures (Day 14 and Day 42)

All mice remaining at the scheduled intervals (Days 14 and 42) will be euthanized by asphyxiation with CO2, and terminal blood collections will be collected via cardiac stick or the inferior vena cava (maximum volume, collection site to be documented in the study records) for processing to serum and plasma. Terminal body weights will be collected prior to euthanasia.

Plasma and Serum Processing

Following terminal collections on Days 14 and 42, respectively, blood will be processed to plasma for Factor Bb analysis and to serum for the hemolytic assay. Blood sample volumes will be divided evenly for plasma and serum processing.

Plasma

Blood samples will be placed into K2 EDTA blood collection tubes and inverted 8-10 times to ensure adequate mixing. Samples will be maintained cold, on ice, and centrifuged in an instrument set to 2-4° C. and ≤1300×g for 10 minutes, within 60 minutes of sample collection. Each plasma sample will be aliquoted into two fresh, labeled collection tubes and stored frozen at ≤−70° C. until analysis is performed.

Serum

Blood samples will be placed into blood collection tubes without anti-coagulant and allowed to clot for 30-60 minutes. Samples will then be processed to serum following centrifugation at 2500×g for 5 minutes in an instrument set to room temperature. Each serum sample will be aliquoted into a fresh, labeled collection tube and snap-frozen with dry ice immediately following collection. Sample tubes will be labeled with the study number and sample type, and stored at ≤−70° C. until analysis is performed.

Organ Processing

Three (3) liver punch biopsies (2 mm) will be obtained from each collected liver (taken from the left, middle, and right lobes, respectively) and placed into separate, labeled 2 mL tubes containing RNALater. Liver punch biopsies will be allowed to soak in the RNALater for 15 minutes, then will be flash-frozen and stored at ≤−70° C.

Results

Mice with humanized liver cells (and retaining about 20 to 25% murine liver cells) have been used to study performance of two specific compounds.

Figure 5:
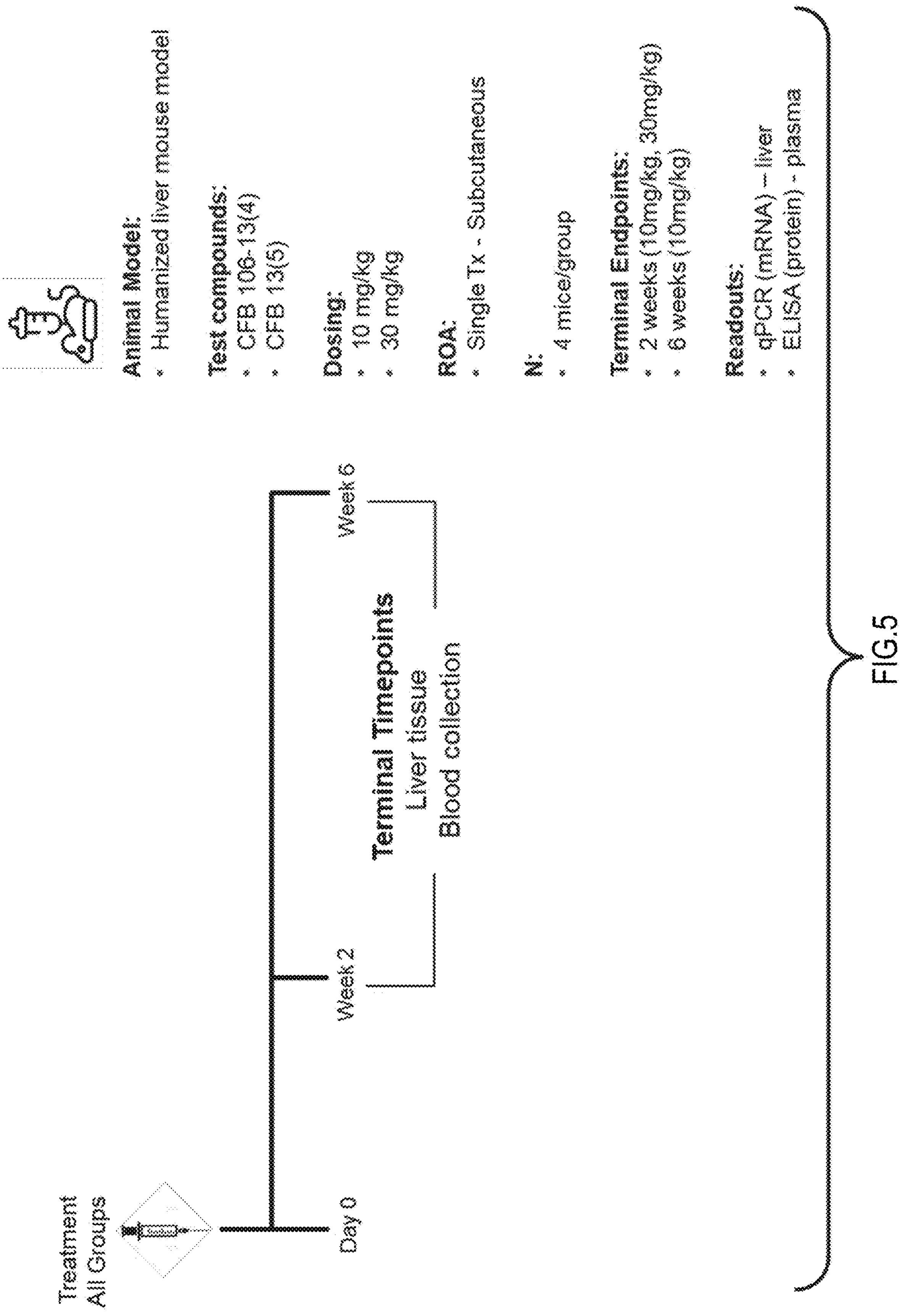
FIG. 5 shows an overview of a study protocol in mice with humanized liver.

FIG. 5 shows an overview of the study protocol.

Figure 6:
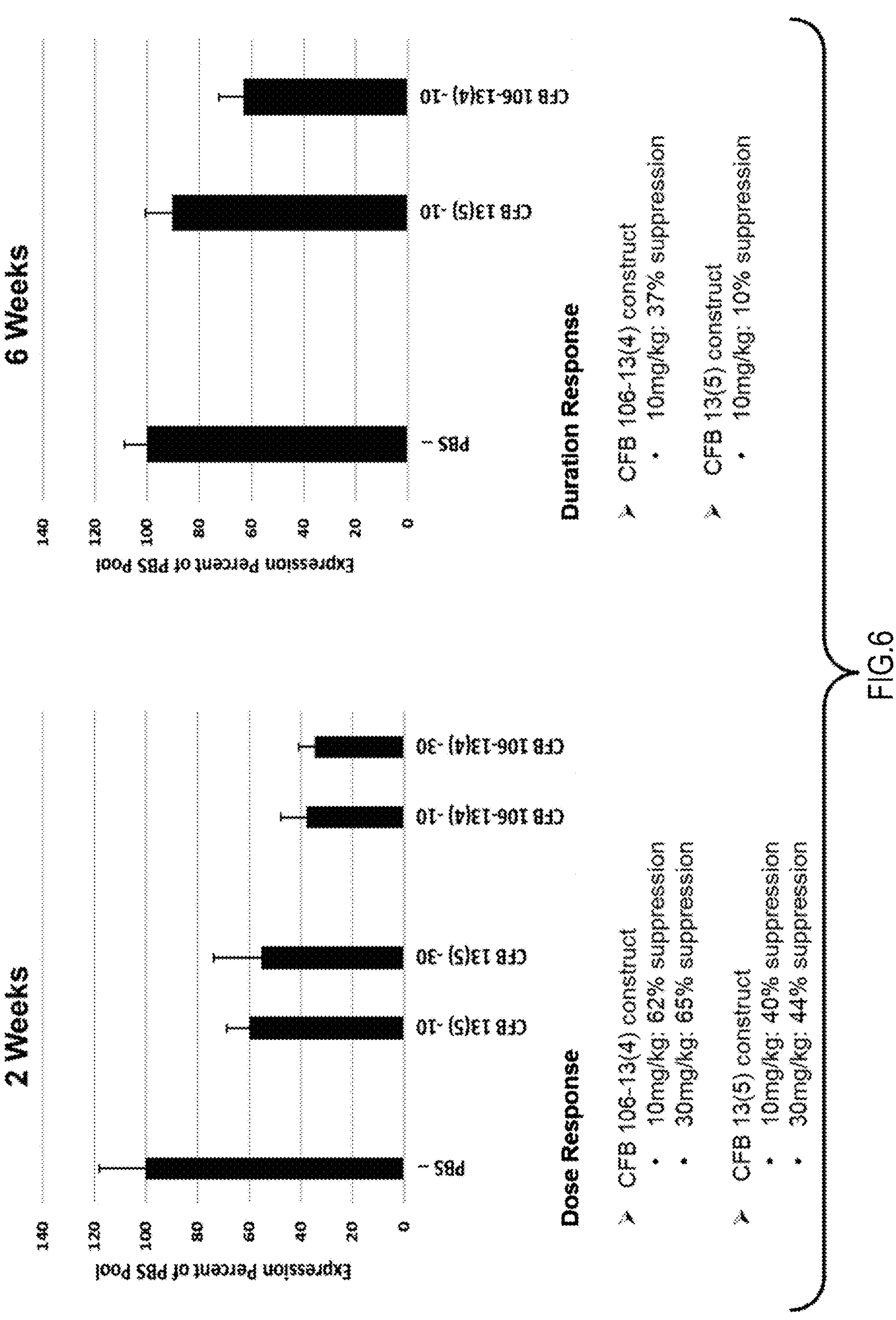
FIG. 6 shows knock-down in the mice at the mRNA level of two compounds compared to negative control after 2 and 6 weeks.

FIG. 6 shows knock-down at the mRNA level by two compounds as compared to negative control after 2 and 6 weeks.

Figure 7:
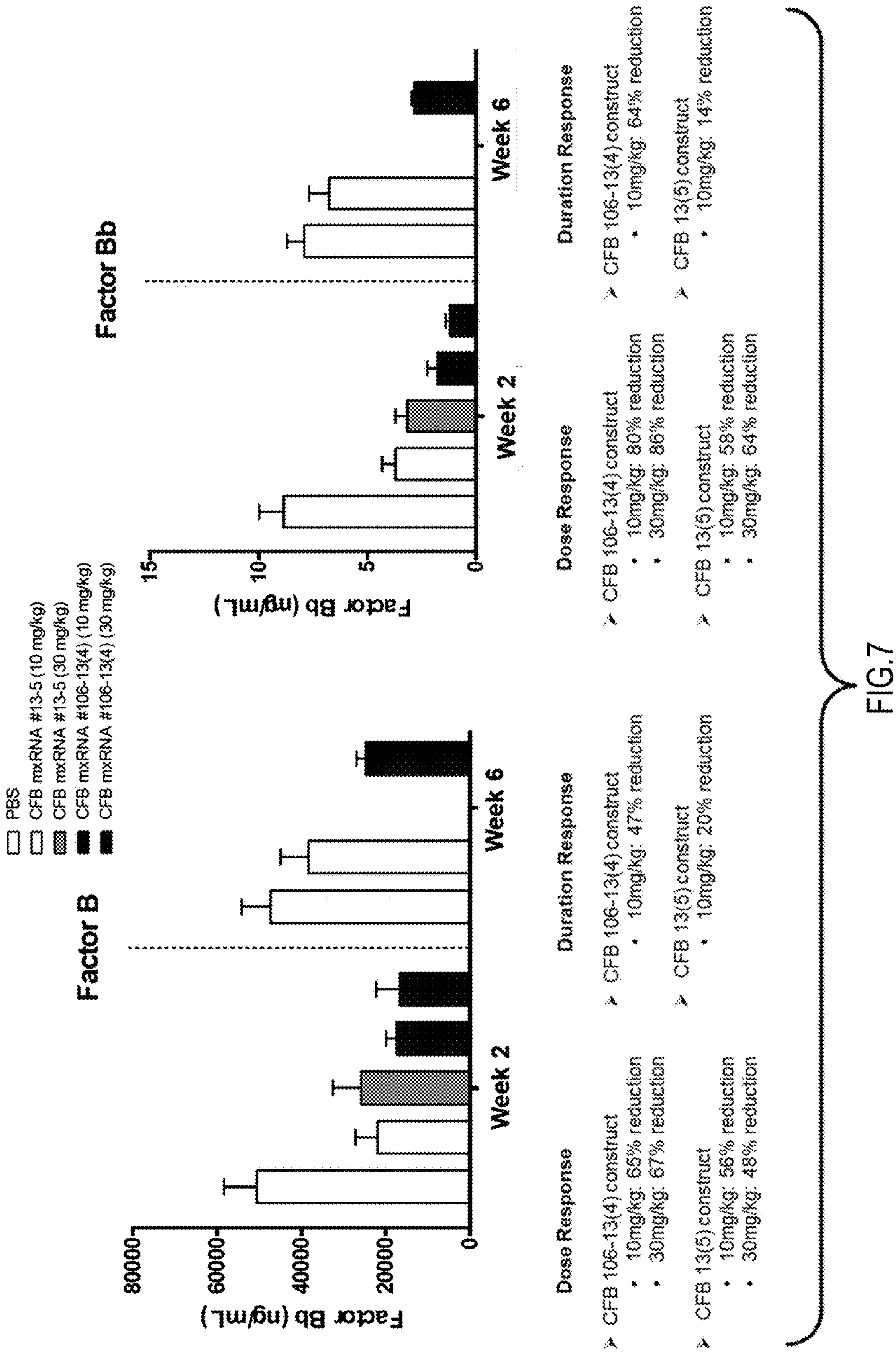
FIG. 7 shows amounts of CFB ("Factor B") as well as of Factor Bb in plasma of the mice as compared to negative control after 2 and 6 weeks.

FIG. 7 shows amounts of CFB ("Factor B") as well as of Factor Bb (as further read-out for CFB and complement pathway down-regulation) in plasma as compared to negative control after 2 and 6 weeks.

The data demonstrate significant knock-down at both mRNA and protein level for both compounds, where 106-13(4) outperforms 13(5). A certain rebound after six weeks, to a lesser extent for the former compound, can be seen.

As regards protein levels, and including component Bb of the complement pathway, an even more persistent knock-down is observed. In particular, compound 106-13(4) shows Bb knock-down in plasma at a level of 64% reduction still after 6 weeks. Such findings are indicative of a favourable dosage regimen requiring administration in large intervals such as every 2, 3, 4, 5, 6, 7, 8, 9 or 10 weeks.

SEQUENCE LISTING (1010 sequences)

SEQ ID NO: 1 - RNA, 19 nt, synthetic construct
  source 1..19: mol_type = other RNA
tagaaaacccaaatcctca

SEQ ID NO: 2 - RNA, 19 nt, synthetic construct
  source 1..19: mol_type = other RNA
gctgtctgatccatctagc

SEQ ID NO: 3 - RNA, 19 nt, synthetic construct
  source 1..19: mol_type = other RNA
aaccatgccacagagactc

SEQ ID NO: 4 - RNA, 19 nt, synthetic construct
  source 1..19: mol_type = other RNA
gatccatctagcaccaggt

SEQ ID NO: 5 - RNA, 19 nt, synthetic construct
  source 1..19: mol_type = other RNA
aaaacccaaatcctcatct

SEQ ID NO: 6 - RNA, 19 nt, synthetic construct
  source 1..19: mol_type = other RNA
tccatctagcaccaggtag

SEQ ID NO: 7 - RNA, 19 nt, synthetic construct
  source 1..19: mol_type = other RNA
gaaaacccaaatcctcatc

SEQ ID NO: 8 - RNA, 19 nt, synthetic construct
  source 1..19: mol_type = other RNA
tgtctgatccatctagcac

SEQ ID NO: 9 - RNA, 19 nt, synthetic construct
  source 1..19: mol_type = other RNA
aacccaaatcctcatcttg

SEQ ID NO: 10 - RNA, 19 nt, synthetic construct
  source 1..19: mol_type = other RNA
atccatctagcaccaggta

SEQ ID NO: 11 - RNA, 19 nt, synthetic construct
  source 1..19: mol_type = other RNA
aaacccaaatcctcatctt

SEQ ID NO: 12 - RNA, 19 nt, synthetic construct
  source 1..19: mol_type = other RNA
ccatgccacagagactcag

SEQ ID NO: 13 - RNA, 19 nt, synthetic construct
  source 1..19: mol_type = other RNA
atgccacagagactcagag

SEQ ID NO: 14 - RNA, 19 nt, synthetic construct
  source 1..19: mol_type = other RNA
gatgatgacatggcgggtg

SEQ ID NO: 15 - RNA, 19 nt, synthetic construct
  source 1..19: mol_type = other RNA
ttccatatccttgactttg

SEQ ID NO: 16 - RNA, 19 nt, synthetic construct
  source 1..19: mol_type = other RNA
tacaccaacttgaatgaaa

SEQ ID NO: 17 - RNA, 19 nt, synthetic construct
  source 1..19: mol_type = other RNA
tgccacagagactcagaga

SEQ ID NO: 18 - RNA, 19 nt, synthetic construct
  source 1..19: mol_type = other RNA
accatgccacagagactca

SEQ ID NO: 19 - RNA, 19 nt, synthetic construct
  source 1..19: mol_type = other RNA
ccatctagcaccaggtaga

SEQ ID NO: 20 - RNA, 19 nt, synthetic construct
  source 1..19: mol_type = other RNA
tttccatatccttgacttt

SEQ ID NO: 21 - RNA, 19 nt, synthetic construct
  source 1..19: mol_type = other RNA
tgatccatctagcaccagg

SEQ ID NO: 22 - RNA, 19 nt, synthetic construct
  source 1..19: mol_type = other RNA
gccacagagactcagagac

SEQ ID NO: 23 - RNA, 19 nt, synthetic construct
  source 1..19: mol_type = other RNA
ctgatccatctagcaccag

SEQ ID NO: 24 - RNA, 19 nt, synthetic construct
  source 1..19: mol_type = other RNA
gacctccttccgagtcagc

SEQ ID NO: 25 - RNA, 19 nt, synthetic construct
  source 1..19: mol_type = other RNA
gtctgatccatctagcacc

SEQ ID NO: 26 - RNA, 19 nt, synthetic construct
  source 1..19: mol_type = other RNA
gtcttggcaggaaggctcc

SEQ ID NO: 27 - RNA, 19 nt, synthetic construct
  source 1..19: mol_type = other RNA
atctagcaccaggtagatg

SEQ ID NO: 28 - RNA, 19 nt, synthetic construct
  source 1..19: mol_type = other RNA
aaagtactcagacaccaca

SEQ ID NO: 29 - RNA, 19 nt, synthetic construct
  source 1..19: mol_type = other RNA
ctgtctgatccatctagca

SEQ ID NO: 30 - RNA, 19 nt, synthetic construct
  source 1..19: mol_type = other RNA
catctagcaccaggtagat

SEQ ID NO: 31 - RNA, 19 nt, synthetic construct
  source 1..19: mol_type = other RNA
ccaaatcctcatcttggag

SEQ ID NO: 32 - RNA, 19 nt, synthetic construct
  source 1..19: mol_type = other RNA
catagtcataaaattcagg

SEQ ID NO: 33 - RNA, 19 nt, synthetic construct
  source 1..19: mol_type = other RNA
gaggatgatgacatggcgg

SEQ ID NO: 34 - RNA, 19 nt, synthetic construct
  source 1..19: mol_type = other RNA
acaatctgtgttctggcac

SEQ ID NO: 35 - RNA, 19 nt, synthetic construct
  source 1..19: mol_type = other RNA
ttgagcttgatcagggcaa

SEQ ID NO: 36 - RNA, 19 nt, synthetic construct
  source 1..19: mol_type = other RNA
cagtggaaagagatctcat

SEQ ID NO: 37 - RNA, 19 nt, synthetic construct
  source 1..19: mol_type = other RNA
tagatgttcatggagcctg

SEQ ID NO: 38 - RNA, 19 nt, synthetic construct
  source 1..19: mol_type = other RNA
ggcaagtggtagttggagg

SEQ ID NO: 39 - RNA, 19 nt, synthetic construct
  source 1..19: mol_type = other RNA
tcacaccataacttgccac

SEQ ID NO: 40 - RNA, 19 nt, synthetic construct
  source 1..19: mol_type = other RNA
gaaagagatctcatcactc

SEQ ID NO: 41 - RNA, 19 nt, synthetic construct
  source 1..19: mol_type = other RNA
ttcaacttgtggtcttcat

SEQ ID NO: 42 - RNA, 19 nt, synthetic construct
  source 1..19: mol_type = other RNA
gaaacgacttctcttgtga

SEQ ID NO: 43 - RNA, 19 nt, synthetic construct
  source 1..19: mol_type = other RNA
ggtatgtggcatatgtcac

SEQ ID NO: 44 - RNA, 19 nt, synthetic construct
  source 1..19: mol_type = other RNA
tgtctttcttggaagccaa

SEQ ID NO: 45 - RNA, 19 nt, synthetic construct
  source 1..19: mol_type = other RNA
acatccagataatcctccc

SEQ ID NO: 46 - RNA, 19 nt, synthetic construct
  source 1..19: mol_type = other RNA
cttgactttgtcatagcct

SEQ ID NO: 47 - RNA, 19 nt, synthetic construct
  source 1..19: mol_type = other RNA
gaaactccagacctagacc

SEQ ID NO: 48 - RNA, 19 nt, synthetic construct
  source 1..19: mol_type = other RNA
cataacttgccaccttctc

SEQ ID NO: 49 - RNA, 19 nt, synthetic construct
  source 1..19: mol_type = other RNA
tcatagtcataaaattcag

SEQ ID NO: 50 - RNA, 19 nt, synthetic construct
  source 1..19: mol_type = other RNA
ttggctcctgtgaagttgc

SEQ ID NO: 51 - RNA, 19 nt, synthetic construct
  source 1..19: mol_type = other RNA
caaagtactcagacaccac

SEQ ID NO: 52 - RNA, 19 nt, synthetic construct
  source 1..19: mol_type = other RNA
tgctcattgtctttcttgg

SEQ ID NO: 53 - RNA, 19 nt, synthetic construct
  source 1..19: mol_type = other RNA
ataaaattcaggaattcct

SEQ ID NO: 54 - RNA, 19 nt, synthetic construct
  source 1..19: mol_type = other RNA
tgagatcttggcctgccat

SEQ ID NO: 55 - RNA, 19 nt, synthetic construct
  source 1..19: mol_type = other RNA
tgagcatctctctcacagc

SEQ ID NO: 56 - RNA, 19 nt, synthetic construct
  source 1..19: mol_type = other RNA
taaccgtcatagcagtgga

SEQ ID NO: 57 - RNA, 19 nt, synthetic construct
  source 1..19: mol_type = other RNA
cagagctttgatatcctgt

SEQ ID NO: 58 - RNA, 19 nt, synthetic construct
  source 1..19: mol_type = other RNA
aacaatgtgctgctgtcag

SEQ ID NO: 59 - RNA, 19 nt, synthetic construct
  source 1..19: mol_type = other RNA
gggtacgggtagaagccag

SEQ ID NO: 60 - RNA, 19 nt, synthetic construct
  source 1..19: mol_type = other RNA
ccagacctagacctggtca

SEQ ID NO: 61 - RNA, 19 nt, synthetic construct
  source 1..19: mol_type = other RNA
cttctcttgtgaactatca

SEQ ID NO: 62 - RNA, 19 nt, synthetic construct
  source 1..19: mol_type = other RNA
attcaggaattcctgcttc

SEQ ID NO: 63 - RNA, 19 nt, synthetic construct
  source 1..19: mol_type = other RNA
tccaggttttccatatcct

SEQ ID NO: 64 - RNA, 19 nt, synthetic construct
  source 1..19: mol_type = other RNA
ccaacttgaatgaaacgac

SEQ ID NO: 65 - RNA, 19 nt, synthetic construct
  source 1..19: mol_type = other RNA
tgtgctgctgtcagcacaa

SEQ ID NO: 66 - RNA, 19 nt, synthetic construct
  source 1..19: mol_type = other RNA
agacctccttccgagtcag

SEQ ID NO: 67 - RNA, 19 nt, synthetic construct
  source 1..19: mol_type = other RNA
tcaattaagttgactagac

SEQ ID NO: 68 - RNA, 19 nt, synthetic construct
  source 1..19: mol_type = other RNA
ctgacacgttcgccgctgg

SEQ ID NO: 69 - RNA, 19 nt, synthetic construct
  source 1..19: mol_type = other RNA
tcattgtctttcttggaag

SEQ ID NO: 70 - RNA, 19 nt, synthetic construct
  source 1..19: mol_type = other RNA
accaacttgaatgaaacga

SEQ ID NO: 71 - RNA, 19 nt, synthetic construct
  source 1..19: mol_type = other RNA
gcacaaagtactcagacac

SEQ ID NO: 72 - RNA, 19 nt, synthetic construct
  source 1..19: mol_type = other RNA
ctgcagtggtaggtgacgc

SEQ ID NO: 73 - RNA, 19 nt, synthetic construct
  source 1..19: mol_type = other RNA
gtcatgaggatgatgacat

SEQ ID NO: 74 - RNA, 19 nt, synthetic construct
  source 1..19: mol_type = other RNA
cttcaacttgtggtcttca

SEQ ID NO: 75 - RNA, 19 nt, synthetic construct
  source 1..19: mol_type = other RNA
ggtagttggaggaagcctc

SEQ ID NO: 76 - RNA, 19 nt, synthetic construct
  source 1..19: mol_type = other RNA
tcatgctgtacactgcctg

SEQ ID NO: 77 - RNA, 19 nt, synthetic construct
  source 1..19: mol_type = other RNA
ttgtctttcttggaagcca

SEQ ID NO: 78 - RNA, 19 nt, synthetic construct
  source 1..19: mol_type = other RNA
tcgactccttctatggtct

SEQ ID NO: 79 - RNA, 19 nt, synthetic construct
  source 1..19: mol_type = other RNA
agacatccagataatcctc

SEQ ID NO: 80 - RNA, 19 nt, synthetic construct
  source 1..19: mol_type = other RNA
ctgagatcttggcctgcca

SEQ ID NO: 81 - RNA, 19 nt, synthetic construct
  source 1..19: mol_type = other RNA
gacgctgtcttcaaggcgg

SEQ ID NO: 82 - RNA, 19 nt, synthetic construct
  source 1..19: mol_type = other RNA
aagacaggaaagcttcggc

SEQ ID NO: 83 - RNA, 19 nt, synthetic construct
  source 1..19: mol_type = other RNA
tttgaacacatgttgctca

SEQ ID NO: 84 - RNA, 19 nt, synthetic construct
  source 1..19: mol_type = other RNA
cataaaattcaggaattcc

SEQ ID NO: 85 - RNA, 19 nt, synthetic construct
  source 1..19: mol_type = other RNA
acccaaatcctcatcttgg

SEQ ID NO: 86 - RNA, 19 nt, synthetic construct
  source 1..19: mol_type = other RNA
aaagagatctcatcactca

SEQ ID NO: 87 - RNA, 19 nt, synthetic construct
  source 1..19: mol_type = other RNA
caaagcattgatgttcact

SEQ ID NO: 88 - RNA, 19 nt, synthetic construct
  source 1..19: mol_type = other RNA
caggaattcctgcttcttt

SEQ ID NO: 89 - RNA, 19 nt, synthetic construct
  source 1..19: mol_type = other RNA
catgaaggagtcttggcag

SEQ ID NO: 90 - RNA, 19 nt, synthetic construct
  source 1..19: mol_type = other RNA
aaagcttcggccacctctt

SEQ ID NO: 91 - RNA, 19 nt, synthetic construct
  source 1..19: mol_type = other RNA
ttgactttgtcatagcctg

SEQ ID NO: 92 - RNA, 19 nt, synthetic construct
  source 1..19: mol_type = other RNA
gtccaagctgaaactccag

SEQ ID NO: 93 - RNA, 19 nt, synthetic construct
  source 1..19: mol_type = other RNA
cccaaatcctcatcttgga

SEQ ID NO: 94 - RNA, 19 nt, synthetic construct
  source 1..19: mol_type = other RNA
gcagctgttttaattcaat

SEQ ID NO: 95 - RNA, 19 nt, synthetic construct
  source 1..19: mol_type = other RNA
aaacgacttctcttgtgaa

SEQ ID NO: 96 - RNA, 19 nt, synthetic construct
  source 1..19: mol_type = other RNA
cccggaacatccaagcggg

SEQ ID NO: 97 - RNA, 19 nt, synthetic construct
  source 1..19: mol_type = other RNA
ccaaacacatagacatcca

SEQ ID NO: 98 - RNA, 19 nt, synthetic construct
  source 1..19: mol_type = other RNA
cttcacaccataacttgcc

SEQ ID NO: 99 - RNA, 19 nt, synthetic construct
  source 1..19: mol_type = other RNA
ttctcttgtgaactatcaa

SEQ ID NO: 100 - RNA, 19 nt, synthetic construct
  source 1..19: mol_type = other RNA
aattcaggaattcctgctt

SEQ ID NO: 101 - RNA, 19 nt, synthetic construct
  source 1..19: mol_type = other RNA
agacactttgacccaaatt

SEQ ID NO: 102 - RNA, 19 nt, synthetic construct
  source 1..19: mol_type = other RNA
acacaaacagagctttgat

SEQ ID NO: 103 - RNA, 19 nt, synthetic construct
  source 1..19: mol_type = other RNA
acaaacagagctttgatat

SEQ ID NO: 104 - RNA, 19 nt, synthetic construct
  source 1..19: mol_type = other RNA
cttggagtttctccttcag

SEQ ID NO: 105 - RNA, 19 nt, synthetic construct
  source 1..19: mol_type = other RNA
ttcacaccataacttgcca

SEQ ID NO: 106 - RNA, 19 nt, synthetic construct
  source 1..19: mol_type = other RNA
ttgaatgaaacgacttctc

SEQ ID NO: 107 - RNA, 19 nt, synthetic construct
  source 1..19: mol_type = other RNA
ccaggttttccatatcctt

SEQ ID NO: 108 - RNA, 19 nt, synthetic construct
  source 1..19: mol_type = other RNA
agcatctctctcacagctg

SEQ ID NO: 109 - RNA, 19 nt, synthetic construct
  source 1..19: mol_type = other RNA
gacatccagataatcctcc

SEQ ID NO: 110 - RNA, 19 nt, synthetic construct
  source 1..19: mol_type = other RNA
tcgagttgttccctcggtg

SEQ ID NO: 111 - RNA, 19 nt, synthetic construct
  source 1..19: mol_type = other RNA
aacacatgttgctcattgt

SEQ ID NO: 112 - RNA, 19 nt, synthetic construct
  source 1..19: mol_type = other RNA
ttctcaattaagttgacta

SEQ ID NO: 113 - RNA, 19 nt, synthetic construct
  source 1..19: mol_type = other RNA
ggaagccaaagcattgatg

SEQ ID NO: 114 - RNA, 19 nt, synthetic construct
  source 1..19: mol_type = other RNA
agcagtggaaagagatctc

SEQ ID NO: 115 - RNA, 19 nt, synthetic construct
  source 1..19: mol_type = other RNA
tacactgcctggagggcct

SEQ ID NO: 116 - RNA, 19 nt, synthetic construct
  source 1..19: mol_type = other RNA
ctagacctggtcacattcc

SEQ ID NO: 117 - RNA, 19 nt, synthetic construct
  source 1..19: mol_type = other RNA
tcagacacaaacagagctt

SEQ ID NO: 118 - RNA, 19 nt, synthetic construct
  source 1..19: mol_type = other RNA
ggagtttctccttcagcca

SEQ ID NO: 119 - RNA, 19 nt, synthetic construct
  source 1..19: mol_type = other RNA
aatgtgctgctgtcagcac

SEQ ID NO: 120 - RNA, 19 nt, synthetic construct
  source 1..19: mol_type = other RNA
acagagctttgatatcctg

SEQ ID NO: 121 - RNA, 19 nt, synthetic construct
  source 1..19: mol_type = other RNA
tgatatcctgtgcagggag

SEQ ID NO: 122 - RNA, 19 nt, synthetic construct
  source 1..19: mol_type = other RNA
cagggcaacgtcatagtca

SEQ ID NO: 123 - RNA, 19 nt, synthetic construct
  source 1..19: mol_type = other RNA
cagacctagacctggtcac

SEQ ID NO: 124 - RNA, 19 nt, synthetic construct
  source 1..19: mol_type = other RNA
aagtactcagacaccacag

SEQ ID NO: 125 - RNA, 19 nt, synthetic construct
  source 1..19: mol_type = other RNA
gaaggctccgtcccgctcc

SEQ ID NO: 126 - RNA, 19 nt, synthetic construct
  source 1..19: mol_type = other RNA
agggcaacgtcatagtcat

SEQ ID NO: 127 - RNA, 19 nt, synthetic construct
  source 1..19: mol_type = other RNA
gctgttttaattcaatccc

SEQ ID NO: 128 - RNA, 19 nt, synthetic construct
  source 1..19: mol_type = other RNA
aagagatctcatcactcac

SEQ ID NO: 129 - RNA, 19 nt, synthetic construct
  source 1..19: mol_type = other RNA
tggtcttcataattgattt

SEQ ID NO: 130 - RNA, 19 nt, synthetic construct
  source 1..19: mol_type = other RNA
ccatatcttggcttcacac

SEQ ID NO: 131 - RNA, 19 nt, synthetic construct
  source 1..19: mol_type = other RNA
acaccaacttgaatgaaac

SEQ ID NO: 132 - RNA, 19 nt, synthetic construct
  source 1..19: mol_type = other RNA
cagctgttttaattcaatc

SEQ ID NO: 133 - RNA, 19 nt, synthetic construct
  source 1..19: mol_type = other RNA
ataacttgccaccttctca

SEQ ID NO: 134 - RNA, 19 nt, synthetic construct
  source 1..19: mol_type = other RNA
gtgagcaggtacctgcttt

SEQ ID NO: 135 - RNA, 19 nt, synthetic construct
  source 1..19: mol_type = other RNA
cttgatgtagacctccttc

SEQ ID NO: 136 - RNA, 19 nt, synthetic construct
  source 1..19: mol_type = other RNA
tggcaagtggtagttggag

SEQ ID NO: 137 - RNA, 19 nt, synthetic construct
  source 1..19: mol_type = other RNA
aggaagcctcaaagctcga

SEQ ID NO: 138 - RNA, 19 nt, synthetic construct
  source 1..19: mol_type = other RNA
caatgacagtaattgggtc

SEQ ID NO: 139 - RNA, 19 nt, synthetic construct
  source 1..19: mol_type = other RNA
ctttgaacacatgttgctc

SEQ ID NO: 140 - RNA, 19 nt, synthetic construct
  source 1..19: mol_type = other RNA
caaatcctcatcttggagt

SEQ ID NO: 141 - RNA, 19 nt, synthetic construct
  source 1..19: mol_type = other RNA
tggagtttctccttcagcc

SEQ ID NO: 142 - RNA, 19 nt, synthetic construct
  source 1..19: mol_type = other RNA
ccataacttgccaccttct

SEQ ID NO: 143 - RNA, 19 nt, synthetic construct
  source 1..19: mol_type = other RNA
agctgttttaattcaatcc

SEQ ID NO: 144 - RNA, 19 nt, synthetic construct
  source 1..19: mol_type = other RNA
aaagctcgagttgttccct

SEQ ID NO: 145 - RNA, 19 nt, synthetic construct
  source 1..19: mol_type = other RNA
gggcaacgtcatagtcata

SEQ ID NO: 146 - RNA, 19 nt, synthetic construct
  source 1..19: mol_type = other RNA
cttccaggttttccatatc

SEQ ID NO: 147 - RNA, 19 nt, synthetic construct
  source 1..19: mol_type = other RNA
ttccaggttttccatatcc

SEQ ID NO: 148 - RNA, 19 nt, synthetic construct
  source 1..19: mol_type = other RNA
cccatgttgtgcaatccat

SEQ ID NO: 149 - RNA, 19 nt, synthetic construct
  source 1..19: mol_type = other RNA
ccatatccttgactttgaa

SEQ ID NO: 150 - RNA, 19 nt, synthetic construct
  source 1..19: mol_type = other RNA
ttgactttgaacacatgtt

SEQ ID NO: 151 - RNA, 19 nt, synthetic construct
  source 1..19: mol_type = other RNA
cctcatcttggagtttctc

SEQ ID NO: 152 - RNA, 19 nt, synthetic construct
  source 1..19: mol_type = other RNA
acatgttgctcattgtctt

SEQ ID NO: 153 - RNA, 19 nt, synthetic construct
  source 1..19: mol_type = other RNA
caccaacttgaatgaaacg

SEQ ID NO: 154 - RNA, 19 nt, synthetic construct
  source 1..19: mol_type = other RNA
cacagatcgctgtctgccc

SEQ ID NO: 155 - RNA, 19 nt, synthetic construct
  source 1..19: mol_type = other RNA
ctcacagctgcctttctta

SEQ ID NO: 156 - RNA, 19 nt, synthetic construct
  source 1..19: mol_type = other RNA
gggccgccagaatcacctc

SEQ ID NO: 157 - RNA, 19 nt, synthetic construct
  source 1..19: mol_type = other RNA
tccaagctgaaactccaga

SEQ ID NO: 158 - RNA, 19 nt, synthetic construct
  source 1..19: mol_type = other RNA
cttgatcagggcaacgtca

SEQ ID NO: 159 - RNA, 19 nt, synthetic construct
  source 1..19: mol_type = other RNA
tgttcccaaaccatgccac

SEQ ID NO: 160 - RNA, 19 nt, synthetic construct
  source 1..19: mol_type = other RNA
tacctgcttttgccgcttc

SEQ ID NO: 161 - RNA, 19 nt, synthetic construct
  source 1..19: mol_type = other RNA
gttgctcattgtctttctt

SEQ ID NO: 162 - RNA, 19 nt, synthetic construct
  source 1..19: mol_type = other RNA
acacgttcgccgctgggag

SEQ ID NO: 163 - RNA, 19 nt, synthetic construct
  source 1..19: mol_type = other RNA
ccattcttgatgtagacct

SEQ ID NO: 164 - RNA, 19 nt, synthetic construct
  source 1..19: mol_type = other RNA
cttgagcttgatcagggca

SEQ ID NO: 165 - RNA, 19 nt, synthetic construct
  source 1..19: mol_type = other RNA
cattcttgatgtagacctc

SEQ ID NO: 166 - RNA, 19 nt, synthetic construct
  source 1..19: mol_type = other RNA
atgaaggagtcttggcagg

SEQ ID NO: 167 - RNA, 19 nt, synthetic construct
  source 1..19: mol_type = other RNA
cttggcttcacaccataac

SEQ ID NO: 168 - RNA, 19 nt, synthetic construct
  source 1..19: mol_type = other RNA
tatcttggcttcacaccat

SEQ ID NO: 169 - RNA, 19 nt, synthetic construct
  source 1..19: mol_type = other RNA
tctcacagctgcctttctt

SEQ ID NO: 170 - RNA, 19 nt, synthetic construct
  source 1..19: mol_type = other RNA
cccaatgctgtctgatcca

SEQ ID NO: 171 - RNA, 19 nt, synthetic construct
  source 1..19: mol_type = other RNA
ggagtggtggtcacacctc

SEQ ID NO: 172 - RNA, 19 nt, synthetic construct
  source 1..19: mol_type = other RNA
catagggactcactcctcc

SEQ ID NO: 173 - RNA, 19 nt, synthetic construct
  source 1..19: mol_type = other RNA
cctgacttcaacttgtggt

SEQ ID NO: 174 - RNA, 19 nt, synthetic construct
  source 1..19: mol_type = other RNA
cttctcaattaagttgact

SEQ ID NO: 175 - RNA, 19 nt, synthetic construct
  source 1..19: mol_type = other RNA
gagtttctccttcagccag

SEQ ID NO: 176 - RNA, 19 nt, synthetic construct
  source 1..19: mol_type = other RNA
gagctttgatatcctgtgc

SEQ ID NO: 177 - RNA, 19 nt, synthetic construct
  source 1..19: mol_type = other RNA
atgtccttgactttgtcat

SEQ ID NO: 178 - RNA, 19 nt, synthetic construct
  source 1..19: mol_type = other RNA
gcaggtacgtgtctgcaca

SEQ ID NO: 179 - RNA, 19 nt, synthetic construct
  source 1..19: mol_type = other RNA
gaaacaatgtgctgctgtc

SEQ ID NO: 180 - RNA, 19 nt, synthetic construct
  source 1..19: mol_type = other RNA
gatatcctgtgcagggagc

SEQ ID NO: 181 - RNA, 19 nt, synthetic construct
  source 1..19: mol_type = other RNA
agactcagagactggcttt

SEQ ID NO: 182 - RNA, 19 nt, synthetic construct
  source 1..19: mol_type = other RNA
tcaatgacagtaattgggt

SEQ ID NO: 183 - RNA, 19 nt, synthetic construct
  source 1..19: mol_type = other RNA
agagccaccttcctgacac

SEQ ID NO: 184 - RNA, 19 nt, synthetic construct
  source 1..19: mol_type = other RNA
ccttgactttgaacacatg

SEQ ID NO: 185 - RNA, 19 nt, synthetic construct
  source 1..19: mol_type = other RNA
aatgaaacgacttctcttg

SEQ ID NO: 186 - RNA, 19 nt, synthetic construct
  source 1..19: mol_type = other RNA
ggaagacaggaaagcttcg

SEQ ID NO: 187 - RNA, 19 nt, synthetic construct
  source 1..19: mol_type = other RNA
agctttgatatcctgtgca

SEQ ID NO: 188 - RNA, 19 nt, synthetic construct
  source 1..19: mol_type = other RNA
ttcttgagcttgatcaggg

SEQ ID NO: 189 - RNA, 19 nt, synthetic construct
  source 1..19: mol_type = other RNA
tggattgctctgcactctg

SEQ ID NO: 190 - RNA, 19 nt, synthetic construct
  source 1..19: mol_type = other RNA
gcatattgagcatctctct

SEQ ID NO: 191 - RNA, 19 nt, synthetic construct
  source 1..19: mol_type = other RNA
tatccttgactttgaacac

SEQ ID NO: 192 - RNA, 19 nt, synthetic construct
  source 1..19: mol_type = other RNA
tgcagacatccactactcc

SEQ ID NO: 193 - RNA, 19 nt, synthetic construct
  source 1..19: mol_type = other RNA
tagacctccttccgagtca

SEQ ID NO: 194 - RNA, 19 nt, synthetic construct
  source 1..19: mol_type = other RNA
caccttctcaattaagttg

SEQ ID NO: 195 - RNA, 19 nt, synthetic construct
  source 1..19: mol_type = other RNA
gagaagtcggaaggagccg

SEQ ID NO: 196 - RNA, 19 nt, synthetic construct
  source 1..19: mol_type = other RNA
ctgcacagggtacgggtag

SEQ ID NO: 197 - RNA, 19 nt, synthetic construct
  source 1..19: mol_type = other RNA
aatgacagtaattgggtcc

SEQ ID NO: 198 - RNA, 19 nt, synthetic construct
  source 1..19: mol_type = other RNA
tgttagtccctgacttcaa

SEQ ID NO: 199 - RNA, 19 nt, synthetic construct
  source 1..19: mol_type = other RNA
catatccttgactttgaac

SEQ ID NO: 200 - RNA, 19 nt, synthetic construct
  source 1..19: mol_type = other RNA
ggtacgtgtctgcacaggg

SEQ ID NO: 201 - RNA, 19 nt, synthetic construct
  source 1..19: mol_type = other RNA
tgtcagcacaaagtactca

SEQ ID NO: 202 - RNA, 19 nt, synthetic construct
  source 1..19: mol_type = other RNA
gtggtcttcataattgatt

SEQ ID NO: 203 - RNA, 19 nt, synthetic construct
  source 1..19: mol_type = other RNA
acagagactcagagactgg

SEQ ID NO: 204 - RNA, 19 nt, synthetic construct
  source 1..19: mol_type = other RNA
atagacatccagataatcc

SEQ ID NO: 205 - RNA, 19 nt, synthetic construct
  source 1..19: mol_type = other RNA
cctccttccgagtcagctt

SEQ ID NO: 206 - RNA, 19 nt, synthetic construct
  source 1..19: mol_type = other RNA
tcatggagcctgaagggtc

SEQ ID NO: 207 - RNA, 19 nt, synthetic construct
  source 1..19: mol_type = other RNA
gtggcatatgtcactagac

SEQ ID NO: 208 - RNA, 19 nt, synthetic construct
  source 1..19: mol_type = other RNA
aaagcattgatgttcactt

SEQ ID NO: 209 - RNA, 19 nt, synthetic construct
  source 1..19: mol_type = other RNA
actcactcctccagtacaa

SEQ ID NO: 210 - RNA, 19 nt, synthetic construct
  source 1..19: mol_type = other RNA
agatgtccttgactttgtc

SEQ ID NO: 211 - RNA, 19 nt, synthetic construct
  source 1..19: mol_type = other RNA
ctgttttaattcaatccca

SEQ ID NO: 212 - RNA, 19 nt, synthetic construct
  source 1..19: mol_type = other RNA
gtagatgttcatggagcct

SEQ ID NO: 213 - RNA, 19 nt, synthetic construct
  source 1..19: mol_type = other RNA
catagcagtggaaagagat

SEQ ID NO: 214 - RNA, 19 nt, synthetic construct
  source 1..19: mol_type = other RNA
ccattcacttggcaggtgc

SEQ ID NO: 215 - RNA, 19 nt, synthetic construct
  source 1..19: mol_type = other RNA
cattgatgttcacttggtt

SEQ ID NO: 216 - RNA, 19 nt, synthetic construct
  source 1..19: mol_type = other RNA
tcagccagggcagcacttg

SEQ ID NO: 217 - RNA, 19 nt, synthetic construct
  source 1..19: mol_type = other RNA
gctcagtgtccaagctgaa

SEQ ID NO: 218 - RNA, 19 nt, synthetic construct
  source 1..19: mol_type = other RNA
tcagagactggctttcatc

SEQ ID NO: 219 - RNA, 19 nt, synthetic construct
  source 1..19: mol_type = other RNA
catccagataatcctccct

SEQ ID NO: 220 - RNA, 19 nt, synthetic construct
  source 1..19: mol_type = other RNA
ccttctcaattaagttgac

SEQ ID NO: 221 - RNA, 19 nt, synthetic construct
  source 1..19: mol_type = other RNA
tccagacctagacctggtc

SEQ ID NO: 222 - RNA, 19 nt, synthetic construct
  source 1..19: mol_type = other RNA
gcaacgtcatagtcataaa

SEQ ID NO: 223 - RNA, 19 nt, synthetic construct
  source 1..19: mol_type = other RNA
cttgaatgaaacgacttct

SEQ ID NO: 224 - RNA, 19 nt, synthetic construct
  source 1..19: mol_type = other RNA
tcctcctcagacacaaaca

SEQ ID NO: 225 - RNA, 19 nt, synthetic construct
  source 1..19: mol_type = other RNA
gaagccaaagcattgatgt

SEQ ID NO: 226 - RNA, 19 nt, synthetic construct
  source 1..19: mol_type = other RNA
atgaaacgacttctcttgt

SEQ ID NO: 227 - RNA, 19 nt, synthetic construct
  source 1..19: mol_type = other RNA
caacttgtggtcttcataa

SEQ ID NO: 228 - RNA, 19 nt, synthetic construct
  source 1..19: mol_type = other RNA
accaggtagatgttcatgg

SEQ ID NO: 229 - RNA, 19 nt, synthetic construct
  source 1..19: mol_type = other RNA
tctgtgttctggcacctgc

SEQ ID NO: 230 - RNA, 19 nt, synthetic construct
  source 1..19: mol_type = other RNA
taacttgccaccttctcaa

SEQ ID NO: 231 - RNA, 19 nt, synthetic construct
  source 1..19: mol_type = other RNA
tgccatggttgcttgtggt

SEQ ID NO: 232 - RNA, 19 nt, synthetic construct
  source 1..19: mol_type = other RNA
agacaaatgggcctgatag

SEQ ID NO: 233 - RNA, 19 nt, synthetic construct
  source 1..19: mol_type = other RNA
taagttgactagacacttt

SEQ ID NO: 234 - RNA, 19 nt, synthetic construct
  source 1..19: mol_type = other RNA
acatggcgggtgcggttcc

SEQ ID NO: 235 - RNA, 19 nt, synthetic construct
  source 1..19: mol_type = other RNA
cccggatctcatcaatgac

SEQ ID NO: 236 - RNA, 19 nt, synthetic construct
  source 1..19: mol_type = other RNA
ggaggaagcctcaaagctc

SEQ ID NO: 237 - RNA, 19 nt, synthetic construct
  source 1..19: mol_type = other RNA
gactttgaacacatgttgc

SEQ ID NO: 238 - RNA, 19 nt, synthetic construct
  source 1..19: mol_type = other RNA
tctcctcctcagacacaaa

SEQ ID NO: 239 - RNA, 19 nt, synthetic construct
  source 1..19: mol_type = other RNA
caggaaggctccgtcccgc

SEQ ID NO: 240 - RNA, 19 nt, synthetic construct
  source 1..19: mol_type = other RNA
ccgccagaatcacctctgc

SEQ ID NO: 241 - RNA, 19 nt, synthetic construct
  source 1..19: mol_type = other RNA
tggaaagagatctcatcac

SEQ ID NO: 242 - RNA, 19 nt, synthetic construct
  source 1..19: mol_type = other RNA
caagtcccggatctcatca

SEQ ID NO: 243 - RNA, 19 nt, synthetic construct
  source 1..19: mol_type = other RNA
tgagcttgatcagggcaac

SEQ ID NO: 244 - RNA, 19 nt, synthetic construct
  source 1..19: mol_type = other RNA
tgttgctcattgtctttct

SEQ ID NO: 245 - RNA, 19 nt, synthetic construct
  source 1..19: mol_type = other RNA
ttgcttgtggtaatcggta

SEQ ID NO: 246 - RNA, 19 nt, synthetic construct
  source 1..19: mol_type = other RNA
ctcatcactcacattgtag

SEQ ID NO: 247 - RNA, 19 nt, synthetic construct
  source 1..19: mol_type = other RNA
tcagtgtccaagctgaaac

SEQ ID NO: 248 - RNA, 19 nt, synthetic construct
  source 1..19: mol_type = other RNA
cccattcttgatgtagacc

SEQ ID NO: 249 - RNA, 19 nt, synthetic construct
  source 1..19: mol_type = other RNA
aaacaatgtgctgctgtca

SEQ ID NO: 250 - RNA, 19 nt, synthetic construct
  source 1..19: mol_type = other RNA
tgacttcaacttgtggtct

SEQ ID NO: 251 - RNA, 19 nt, synthetic construct
  source 1..19: mol_type = other RNA
ttgccacagagactcagag

SEQ ID NO: 252 - RNA, 19 nt, synthetic construct
  source 1..19: mol_type = other RNA
ttgaatgaaacgacttctc

SEQ ID NO: 253 - RNA, 15 nt, synthetic construct
  source 1..15: mol_type = other RNA
gatttgggttttcta

SEQ ID NO: 254 - RNA, 15 nt, synthetic construct
  source 1..15: mol_type = other RNA
gatggatcagacagc

SEQ ID NO: 255 - RNA, 15 nt, synthetic construct
  source 1..15: mol_type = other RNA
ctctgtggcatggtt

SEQ ID NO: 256 - RNA, 15 nt, synthetic construct
  source 1..15: mol_type = other RNA
ggtgctagatggatc

SEQ ID NO: 257 - RNA, 15 nt, synthetic construct
  source 1..15: mol_type = other RNA
gaggatttgggtttt

SEQ ID NO: 258 - RNA, 15 nt, synthetic construct
  source 1..15: mol_type = other RNA
ctggtgctagatgga

SEQ ID NO: 259 - RNA, 15 nt, synthetic construct
  source 1..15: mol_type = other RNA
aggatttgggttttc

SEQ ID NO: 260 - RNA, 15 nt, synthetic construct
  source 1..15: mol_type = other RNA
tagatggatcagaca

SEQ ID NO: 261 - RNA, 15 nt, synthetic construct
  source 1..15: mol_type = other RNA
atgaggatttgggtt

SEQ ID NO: 262 - RNA, 15 nt, synthetic construct
  source 1..15: mol_type = other RNA
tggtgctagatggat

SEQ ID NO: 263 - RNA, 15 nt, synthetic construct
  source 1..15: mol_type = other RNA
tgaggatttgggttt

SEQ ID NO: 264 - RNA, 15 nt, synthetic construct
  source 1..15: mol_type = other RNA
gtctctgtggcatgg

SEQ ID NO: 265 - RNA, 15 nt, synthetic construct
  source 1..15: mol_type = other RNA
gagtctctgtggcat

SEQ ID NO: 266 - RNA, 15 nt, synthetic construct
  source 1..15: mol_type = other RNA
cgccatgtcatcatc

SEQ ID NO: 267 - RNA, 15 nt, synthetic construct
  source 1..15: mol_type = other RNA
gtcaaggatatggaa

SEQ ID NO: 268 - RNA, 15 nt, synthetic construct
  source 1..15: mol_type = other RNA
attcaagttggtgta

SEQ ID NO: 269 - RNA, 15 nt, synthetic construct
  source 1..15: mol_type = other RNA
tgagtctctgtggca

SEQ ID NO: 270 - RNA, 15 nt, synthetic construct
  source 1..15: mol_type = other RNA
tctctgtggcatggt

SEQ ID NO: 271 - RNA, 15 nt, synthetic construct
  source 1..15: mol_type = other RNA
cctggtgctagatgg

SEQ ID NO: 272 - RNA, 15 nt, synthetic construct
  source 1..15: mol_type = other RNA
tcaaggatatggaaa

SEQ ID NO: 273 - RNA, 15 nt, synthetic construct
  source 1..15: mol_type = other RNA
gtgctagatggatca

SEQ ID NO: 274 - RNA, 15 nt, synthetic construct
  source 1..15: mol_type = other RNA
ctgagtctctgtggc

SEQ ID NO: 275 - RNA, 15 nt, synthetic construct
  source 1..15: mol_type = other RNA
tgctagatggatcag

SEQ ID NO: 276 - RNA, 15 nt, synthetic construct
  source 1..15: mol_type = other RNA
actcggaaggaggtc

SEQ ID NO: 277 - RNA, 15 nt, synthetic construct
  source 1..15: mol_type = other RNA
ctagatggatcagac

SEQ ID NO: 278 - RNA, 15 nt, synthetic construct
  source 1..15: mol_type = other RNA
ccttcctgccaagac

SEQ ID NO: 279 - RNA, 15 nt, synthetic construct
  source 1..15: mol_type = other RNA
tacctggtgctagat

SEQ ID NO: 280 - RNA, 15 nt, synthetic construct
  source 1..15: mol_type = other RNA
gtgtctgagtacttt

SEQ ID NO: 281 - RNA, 15 nt, synthetic construct
  source 1..15: mol_type = other RNA
agatggatcagacag

SEQ ID NO: 282 - RNA, 15 nt, synthetic construct
  source 1..15: mol_type = other RNA
acctggtgctagatg

SEQ ID NO: 283 - RNA, 15 nt, synthetic construct
  source 1..15: mol_type = other RNA
aagatgaggatttgg

SEQ ID NO: 284 - RNA, 15 nt, synthetic construct
  source 1..15: mol_type = other RNA
aattttatgactatg

SEQ ID NO: 285 - RNA, 15 nt, synthetic construct
  source 1..15: mol_type = other RNA
catgtcatcatcctc

SEQ ID NO: 286 - RNA, 15 nt, synthetic construct
  source 1..15: mol_type = other RNA
cagaacacagattgt

SEQ ID NO: 287 - RNA, 15 nt, synthetic construct
  source 1..15: mol_type = other RNA
cctgatcaagctcaa

SEQ ID NO: 288 - RNA, 15 nt, synthetic construct
  source 1..15: mol_type = other RNA
gatctctttccactg

SEQ ID NO: 289 - RNA, 15 nt, synthetic construct
  source 1..15: mol_type = other RNA
ctccatgaacatcta

SEQ ID NO: 290 - RNA, 15 nt, synthetic construct
  source 1..15: mol_type = other RNA
caactaccacttgcc

SEQ ID NO: 291 - RNA, 15 nt, synthetic construct
  source 1..15: mol_type = other RNA
caagttatggtgtga

SEQ ID NO: 292 - RNA, 15 nt, synthetic construct
  source 1..15: mol_type = other RNA
gatgagatctctttc

SEQ ID NO: 293 - RNA, 15 nt, synthetic construct
  source 1..15: mol_type = other RNA
agaccacaagttgaa

SEQ ID NO: 294 - RNA, 15 nt, synthetic construct
  source 1..15: mol_type = other RNA
aagagaagtcgtttc

SEQ ID NO: 295 - RNA, 15 nt, synthetic construct
  source 1..15: mol_type = other RNA
catatgccacatacc

SEQ ID NO: 296 - RNA, 15 nt, synthetic construct
  source 1..15: mol_type = other RNA
cttccaagaaagaca

SEQ ID NO: 297 - RNA, 15 nt, synthetic construct
  source 1..15: mol_type = other RNA
ggattatctggatgt

SEQ ID NO: 298 - RNA, 15 nt, synthetic construct
  source 1..15: mol_type = other RNA
tatgacaaagtcaag

SEQ ID NO: 299 - RNA, 15 nt, synthetic construct
  source 1..15: mol_type = other RNA
taggtctggagtttc

SEQ ID NO: 300 - RNA, 15 nt, synthetic construct
  source 1..15: mol_type = other RNA
aggtggcaagttatg

SEQ ID NO: 301 - RNA, 15 nt, synthetic construct
  source 1..15: mol_type = other RNA
attttatgactatga

SEQ ID NO: 302 - RNA, 15 nt, synthetic construct
  source 1..15: mol_type = other RNA
cttcacaggagccaa

SEQ ID NO: 303 - RNA, 15 nt, synthetic construct
  source 1..15: mol_type = other RNA
tgtctgagtactttg

SEQ ID NO: 304 - RNA, 15 nt, synthetic construct
  source 1..15: mol_type = other RNA
gaaagacaatgagca

SEQ ID NO: 305 - RNA, 15 nt, synthetic construct
  source 1..15: mol_type = other RNA
attcctgaattttat

SEQ ID NO: 306 - RNA, 15 nt, synthetic construct
  source 1..15: mol_type = other RNA
caggccaagatctca

SEQ ID NO: 307 - RNA, 15 nt, synthetic construct
  source 1..15: mol_type = other RNA
tgagagagatgctca

SEQ ID NO: 308 - RNA, 15 nt, synthetic construct
  source 1..15: mol_type = other RNA
ctgctatgacggtta

SEQ ID NO: 309 - RNA, 15 nt, synthetic construct
  source 1..15: mol_type = other RNA
gatatcaaagctctg

SEQ ID NO: 310 - RNA, 15 nt, synthetic construct
  source 1..15: mol_type = other RNA
cagcagcacattgtt

SEQ ID NO: 311 - RNA, 15 nt, synthetic construct
  source 1..15: mol_type = other RNA
cttctacccgtaccc

SEQ ID NO: 312 - RNA, 15 nt, synthetic construct
  source 1..15: mol_type = other RNA
caggtctaggtctgg

SEQ ID NO: 313 - RNA, 15 nt, synthetic construct
  source 1..15: mol_type = other RNA
agttcacaagagaag

SEQ ID NO: 314 - RNA, 15 nt, synthetic construct
  source 1..15: mol_type = other RNA
caggaattcctgaat

SEQ ID NO: 315 - RNA, 15 nt, synthetic construct
  source 1..15: mol_type = other RNA
tatggaaaacctgga

SEQ ID NO: 316 - RNA, 15 nt, synthetic construct
  source 1..15: mol_type = other RNA
tttcattcaagttgg

SEQ ID NO: 317 - RNA, 15 nt, synthetic construct
  source 1..15: mol_type = other RNA
gctgacagcagcaca

SEQ ID NO: 318 - RNA, 15 nt, synthetic construct
  source 1..15: mol_type = other RNA
ctcggaaggaggtct

SEQ ID NO: 319 - RNA, 15 nt, synthetic construct
  source 1..15: mol_type = other RNA
agtcaacttaattga

SEQ ID NO: 320 - RNA, 15 nt, synthetic construct
  source 1..15: mol_type = other RNA
cggcgaacgtgtcag

SEQ ID NO: 321 - RNA, 15 nt, synthetic construct
  source 1..15: mol_type = other RNA
caagaaagacaatga

SEQ ID NO: 322 - RNA, 15 nt, synthetic construct
  source 1..15: mol_type = other RNA
ttcattcaagttggt

SEQ ID NO: 323 - RNA, 15 nt, synthetic construct
  source 1..15: mol_type = other RNA
ctgagtactttgtgc

SEQ ID NO: 324 - RNA, 15 nt, synthetic construct
  source 1..15: mol_type = other RNA
cacctaccactgcag

SEQ ID NO: 325 - RNA, 15 nt, synthetic construct
  source 1..15: mol_type = other RNA
catcatcctcatgac

SEQ ID NO: 326 - RNA, 15 nt, synthetic construct
  source 1..15: mol_type = other RNA
gaccacaagttgaag

SEQ ID NO: 327 - RNA, 15 nt, synthetic construct
  source 1..15: mol_type = other RNA
cttcctccaactacc

SEQ ID NO: 328 - RNA, 15 nt, synthetic construct
  source 1..15: mol_type = other RNA
cagtgtacagcatga

SEQ ID NO: 329 - RNA, 15 nt, synthetic construct
  source 1..15: mol_type = other RNA
ttccaagaaagacaa

SEQ ID NO: 330 - RNA, 15 nt, synthetic construct
  source 1..15: mol_type = other RNA
catagaaggagtcga

SEQ ID NO: 331 - RNA, 15 nt, synthetic construct
  source 1..15: mol_type = other RNA
attatctggatgtct

SEQ ID NO: 332 - RNA, 15 nt, synthetic construct
  source 1..15: mol_type = other RNA
aggccaagatctcag

SEQ ID NO: 333 - RNA, 15 nt, synthetic construct
  source 1..15: mol_type = other RNA
cttgaagacagcgtc

SEQ ID NO: 334 - RNA, 15 nt, synthetic construct
  source 1..15: mol_type = other RNA
aagctttcctgtctt

SEQ ID NO: 335 - RNA, 15 nt, synthetic construct
  source 1..15: mol_type = other RNA
caacatgtgttcaaa

SEQ ID NO: 336 - RNA, 15 nt, synthetic construct
  source 1..15: mol_type = other RNA
ttcctgaattttatg

SEQ ID NO: 337 - RNA, 15 nt, synthetic construct
  source 1..15: mol_type = other RNA
gatgaggatttgggt

SEQ ID NO: 338 - RNA, 15 nt, synthetic construct
  source 1..15: mol_type = other RNA
tgatgagatctcttt

SEQ ID NO: 339 - RNA, 15 nt, synthetic construct
  source 1..15: mol_type = other RNA
aacatcaatgctttg

SEQ ID NO: 340 - RNA, 15 nt, synthetic construct
  source 1..15: mol_type = other RNA
aagcaggaattcctg

SEQ ID NO: 341 - RNA, 15 nt, synthetic construct
  source 1..15: mol_type = other RNA
caagactccttcatg

SEQ ID NO: 342 - RNA, 15 nt, synthetic construct
  source 1..15: mol_type = other RNA
ggtggccgaagcttt

SEQ ID NO: 343 - RNA, 15 nt, synthetic construct
  source 1..15: mol_type = other RNA
ctatgacaaagtcaa

SEQ ID NO: 344 - RNA, 15 nt, synthetic construct
  source 1..15: mol_type = other RNA
agtttcagcttggac

SEQ ID NO: 345 - RNA, 15 nt, synthetic construct
  source 1..15: mol_type = other RNA
agatgaggatttggg

SEQ ID NO: 346 - RNA, 15 nt, synthetic construct
  source 1..15: mol_type = other RNA
aattaaaacagctgc

SEQ ID NO: 347 - RNA, 15 nt, synthetic construct
  source 1..15: mol_type = other RNA
caagagaagtcgttt

SEQ ID NO: 348 - RNA, 15 nt, synthetic construct
  source 1..15: mol_type = other RNA
cttggatgttccggg

SEQ ID NO: 349 - RNA, 15 nt, synthetic construct
  source 1..15: mol_type = other RNA
tgtctatgtgtttgg

SEQ ID NO: 350 - RNA, 15 nt, synthetic construct
  source 1..15: mol_type = other RNA
agttatggtgtgaag

SEQ ID NO: 351 - RNA, 15 nt, synthetic construct
  source 1..15: mol_type = other RNA
tagttcacaagagaa

SEQ ID NO: 352 - RNA, 15 nt, synthetic construct
  source 1..15: mol_type = other RNA
aggaattcctgaatt

SEQ ID NO: 353 - RNA, 15 nt, synthetic construct
  source 1..15: mol_type = other RNA
tgggtcaaagtgtct

SEQ ID NO: 354 - RNA, 15 nt, synthetic construct
  source 1..15: mol_type = other RNA
aagctctgtttgtgt

SEQ ID NO: 355 - RNA, 15 nt, synthetic construct
  source 1..15: mol_type = other RNA
caaagctctgtttgt

SEQ ID NO: 356 - RNA, 15 nt, synthetic construct
  source 1..15: mol_type = other RNA
aggagaaactccaag

SEQ ID NO: 357 - RNA, 15 nt, synthetic construct
  source 1..15: mol_type = other RNA
aagttatggtgtgaa

SEQ ID NO: 358 - RNA, 15 nt, synthetic construct
  source 1..15: mol_type = other RNA
agtcgtttcattcaa

SEQ ID NO: 359 - RNA, 15 nt, synthetic construct
  source 1..15: mol_type = other RNA
atatggaaaacctgg

SEQ ID NO: 360 - RNA, 15 nt, synthetic construct
  source 1..15: mol_type = other RNA
tgtgagagagatgct

SEQ ID NO: 361 - RNA, 15 nt, synthetic construct
  source 1..15: mol_type = other RNA
gattatctggatgtc

SEQ ID NO: 362 - RNA, 15 nt, synthetic construct
  source 1..15: mol_type = other RNA
gagggaacaactcga

SEQ ID NO: 363 - RNA, 15 nt, synthetic construct
  source 1..15: mol_type = other RNA
tgagcaacatgtgtt

SEQ ID NO: 364 - RNA, 15 nt, synthetic construct
  source 1..15: mol_type = other RNA
caacttaattgagaa

SEQ ID NO: 365 - RNA, 15 nt, synthetic construct
  source 1..15: mol_type = other RNA
aatgctttggcttcc

SEQ ID NO: 366 - RNA, 15 nt, synthetic construct
  source 1..15: mol_type = other RNA
tctctttccactgct

SEQ ID NO: 367 - RNA, 15 nt, synthetic construct
  source 1..15: mol_type = other RNA
cctccaggcagtgta

SEQ ID NO: 368 - RNA, 15 nt, synthetic construct
  source 1..15: mol_type = other RNA
tgtgaccaggtctag

SEQ ID NO: 369 - RNA, 15 nt, synthetic construct
  source 1..15: mol_type = other RNA
tctgtttgtgtctga

SEQ ID NO: 370 - RNA, 15 nt, synthetic construct
  source 1..15: mol_type = other RNA
tgaaggagaaactcc

SEQ ID NO: 371 - RNA, 15 nt, synthetic construct
  source 1..15: mol_type = other RNA
tgacagcagcacatt

SEQ ID NO: 372 - RNA, 15 nt, synthetic construct
  source 1..15: mol_type = other RNA
atatcaaagctctgt

SEQ ID NO: 373 - RNA, 15 nt, synthetic construct
  source 1..15: mol_type = other RNA
ctgcacaggatatca

SEQ ID NO: 374 - RNA, 15 nt, synthetic construct
  source 1..15: mol_type = other RNA
tatgacgttgccctg

SEQ ID NO: 375 - RNA, 15 nt, synthetic construct
  source 1..15: mol_type = other RNA
ccaggtctaggtctg

SEQ ID NO: 376 - RNA, 15 nt, synthetic construct
  source 1..15: mol_type = other RNA
ggtgtctgagtactt

SEQ ID NO: 377 - RNA, 15 nt, synthetic construct
  source 1..15: mol_type = other RNA
cgggacggagccttc

SEQ ID NO: 378 - RNA, 15 nt, synthetic construct
  source 1..15: mol_type = other RNA
ctatgacgttgccct

SEQ ID NO: 379 - RNA, 15 nt, synthetic construct
  source 1..15: mol_type = other RNA
ttgaattaaaacagc

SEQ ID NO: 380 - RNA, 15 nt, synthetic construct
  source 1..15: mol_type = other RNA
gtgatgagatctctt

SEQ ID NO: 381 - RNA, 15 nt, synthetic construct
  source 1..15: mol_type = other RNA
caattatgaagacca

SEQ ID NO: 382 - RNA, 15 nt, synthetic construct
  source 1..15: mol_type = other RNA
gaagccaagatatgg

SEQ ID NO: 383 - RNA, 15 nt, synthetic construct
  source 1..15: mol_type = other RNA
cattcaagttggtgt

SEQ ID NO: 384 - RNA, 15 nt, synthetic construct
  source 1..15: mol_type = other RNA
gaattaaaacagctg

SEQ ID NO: 385 - RNA, 15 nt, synthetic construct
  source 1..15: mol_type = other RNA
aaggtggcaagttat

SEQ ID NO: 386 - RNA, 15 nt, synthetic construct
  source 1..15: mol_type = other RNA
caggtacctgctcac

SEQ ID NO: 387 - RNA, 15 nt, synthetic construct
  source 1..15: mol_type = other RNA
gaggtctacatcaag

SEQ ID NO: 388 - RNA, 15 nt, synthetic construct
  source 1..15: mol_type = other RNA
aactaccacttgcca

SEQ ID NO: 389 - RNA, 15 nt, synthetic construct
  source 1..15: mol_type = other RNA
gctttgaggcttcct

SEQ ID NO: 390 - RNA, 15 nt, synthetic construct
  source 1..15: mol_type = other RNA
caattactgtcattg

SEQ ID NO: 391 - RNA, 15 nt, synthetic construct
  source 1..15: mol_type = other RNA
aacatgtgttcaaag

SEQ ID NO: 392 - RNA, 15 nt, synthetic construct
  source 1..15: mol_type = other RNA
caagatgaggatttg

SEQ ID NO: 393 - RNA, 15 nt, synthetic construct
  source 1..15: mol_type = other RNA
gaaggagaaactcca

SEQ ID NO: 394 - RNA, 15 nt, synthetic construct
  source 1..15: mol_type = other RNA
ggtggcaagttatgg

SEQ ID NO: 395 - RNA, 15 nt, synthetic construct
  source 1..15: mol_type = other RNA
tgaattaaaacagct

SEQ ID NO: 396 - RNA, 15 nt, synthetic construct
  source 1..15: mol_type = other RNA
aacaactcgagcttt

SEQ ID NO: 397 - RNA, 15 nt, synthetic construct
  source 1..15: mol_type = other RNA
actatgacgttgccc

SEQ ID NO: 398 - RNA, 15 nt, synthetic construct
  source 1..15: mol_type = other RNA
tggaaaacctggaag

SEQ ID NO: 399 - RNA, 15 nt, synthetic construct
  source 1..15: mol_type = other RNA
atggaaaacctggaa

SEQ ID NO: 400 - RNA, 15 nt, synthetic construct
  source 1..15: mol_type = other RNA
attgcacaacatggg

SEQ ID NO: 401 - RNA, 15 nt, synthetic construct
  source 1..15: mol_type = other RNA
aagtcaaggatatgg

SEQ ID NO: 402 - RNA, 15 nt, synthetic construct
  source 1..15: mol_type = other RNA
tgtgttcaaagtcaa

SEQ ID NO: 403 - RNA, 15 nt, synthetic construct
  source 1..15: mol_type = other RNA
aactccaagatgagg

SEQ ID NO: 404 - RNA, 15 nt, synthetic construct
  source 1..15: mol_type = other RNA
caatgagcaacatgt

SEQ ID NO: 405 - RNA, 15 nt, synthetic construct
  source 1..15: mol_type = other RNA
tcattcaagttggtg

SEQ ID NO: 406 - RNA, 15 nt, synthetic construct
  source 1..15: mol_type = other RNA
agacagcgatctgtg

SEQ ID NO: 407 - RNA, 15 nt, synthetic construct
  source 1..15: mol_type = other RNA
aaaggcagctgtgag

SEQ ID NO: 408 - RNA, 15 nt, synthetic construct
  source 1..15: mol_type = other RNA
tgattctggcggccc

SEQ ID NO: 409 - RNA, 15 nt, synthetic construct
  source 1..15: mol_type = other RNA
gagtttcagcttgga

SEQ ID NO: 410 - RNA, 15 nt, synthetic construct
  source 1..15: mol_type = other RNA
gttgccctgatcaag

SEQ ID NO: 411 - RNA, 15 nt, synthetic construct
  source 1..15: mol_type = other RNA
catggtttgggaaca

SEQ ID NO: 412 - RNA, 15 nt, synthetic construct
  source 1..15: mol_type = other RNA
cggcaaaagcaggta

SEQ ID NO: 413 - RNA, 15 nt, synthetic construct
  source 1..15: mol_type = other RNA
aagacaatgagcaac

SEQ ID NO: 414 - RNA, 15 nt, synthetic construct
  source 1..15: mol_type = other RNA
cagcggcgaacgtgt

SEQ ID NO: 415 - RNA, 15 nt, synthetic construct
  source 1..15: mol_type = other RNA
ctacatcaagaatgg

SEQ ID NO: 416 - RNA, 15 nt, synthetic construct
  source 1..15: mol_type = other RNA
ctgatcaagctcaag

SEQ ID NO: 417 - RNA, 15 nt, synthetic construct
  source 1..15: mol_type = other RNA
tctacatcaagaatg

SEQ ID NO: 418 - RNA, 15 nt, synthetic construct
  source 1..15: mol_type = other RNA
ccaagactccttcat

SEQ ID NO: 419 - RNA, 15 nt, synthetic construct
  source 1..15: mol_type = other RNA
tggtgtgaagccaag

SEQ ID NO: 420 - RNA, 15 nt, synthetic construct
  source 1..15: mol_type = other RNA
tgtgaagccaagata

SEQ ID NO: 421 - RNA, 15 nt, synthetic construct
  source 1..15: mol_type = other RNA
aaggcagctgtgaga

SEQ ID NO: 422 - RNA, 15 nt, synthetic construct
  source 1..15: mol_type = other RNA
tcagacagcattggg

SEQ ID NO: 423 - RNA, 15 nt, synthetic construct
  source 1..15: mol_type = other RNA
tgtgaccaccactcc

SEQ ID NO: 424 - RNA, 15 nt, synthetic construct
  source 1..15: mol_type = other RNA
gagtgagtccctatg

SEQ ID NO: 425 - RNA, 15 nt, synthetic construct
  source 1..15: mol_type = other RNA
caagttgaagtcagg

SEQ ID NO: 426 - RNA, 15 nt, synthetic construct
  source 1..15: mol_type = other RNA
aacttaattgagaag

SEQ ID NO: 427 - RNA, 15 nt, synthetic construct
  source 1..15: mol_type = other RNA
ctgaaggagaaactc

SEQ ID NO: 428 - RNA, 15 nt, synthetic construct
  source 1..15: mol_type = other RNA
aggatatcaaagctc

SEQ ID NO: 429 - RNA, 15 nt, synthetic construct
  source 1..15: mol_type = other RNA
caaagtcaaggacat

SEQ ID NO: 430 - RNA, 15 nt, synthetic construct
  source 1..15: mol_type = other RNA
cagacacgtacctgc

SEQ ID NO: 431 - RNA, 15 nt, synthetic construct
  source 1..15: mol_type = other RNA
gcagcacattgtttc

SEQ ID NO: 432 - RNA, 15 nt, synthetic construct
  source 1..15: mol_type = other RNA
cctgcacaggatatc

SEQ ID NO: 433 - RNA, 15 nt, synthetic construct
  source 1..15: mol_type = other RNA
ccagtctctgagtct

SEQ ID NO: 434 - RNA, 15 nt, synthetic construct
  source 1..15: mol_type = other RNA
aattactgtcattga

SEQ ID NO: 435 - RNA, 15 nt, synthetic construct
  source 1..15: mol_type = other RNA
caggaaggtggctct

SEQ ID NO: 436 - RNA, 15 nt, synthetic construct
  source 1..15: mol_type = other RNA
tgttcaaagtcaagg

SEQ ID NO: 437 - RNA, 15 nt, synthetic construct
  source 1..15: mol_type = other RNA
agaagtcgtttcatt

SEQ ID NO: 438 - RNA, 15 nt, synthetic construct
  source 1..15: mol_type = other RNA
gctttcctgtcttcc

SEQ ID NO: 439 - RNA, 15 nt, synthetic construct
  source 1..15: mol_type = other RNA
caggatatcaaagct

SEQ ID NO: 440 - RNA, 15 nt, synthetic construct
  source 1..15: mol_type = other RNA
gatcaagctcaagaa

SEQ ID NO: 441 - RNA, 15 nt, synthetic construct
  source 1..15: mol_type = other RNA
gtgcagagcaatcca

SEQ ID NO: 442 - RNA, 15 nt, synthetic construct
  source 1..15: mol_type = other RNA
agatgctcaatatgc

SEQ ID NO: 443 - RNA, 15 nt, synthetic construct
  source 1..15: mol_type = other RNA
tcaaagtcaaggata

SEQ ID NO: 444 - RNA, 15 nt, synthetic construct
  source 1..15: mol_type = other RNA
tagtggatgtctgca

SEQ ID NO: 445 - RNA, 15 nt, synthetic construct
  source 1..15: mol_type = other RNA
tcggaaggaggtcta

SEQ ID NO: 446 - RNA, 15 nt, synthetic construct
  source 1..15: mol_type = other RNA
ttaattgagaaggtg

SEQ ID NO: 447 - RNA, 15 nt, synthetic construct
  source 1..15: mol_type = other RNA
tccttccgacttctc

SEQ ID NO: 448 - RNA, 15 nt, synthetic construct
  source 1..15: mol_type = other RNA
ccgtaccctgtgcag

SEQ ID NO: 449 - RNA, 15 nt, synthetic construct
  source 1..15: mol_type = other RNA
ccaattactgtcatt

SEQ ID NO: 450 - RNA, 15 nt, synthetic construct
  source 1..15: mol_type = other RNA
agtcagggactaaca

SEQ ID NO: 451 - RNA, 15 nt, synthetic construct
  source 1..15: mol_type = other RNA
aaagtcaaggatatg

SEQ ID NO: 452 - RNA, 15 nt, synthetic construct
  source 1..15: mol_type = other RNA
gtgcagacacgtacc

SEQ ID NO: 453 - RNA, 15 nt, synthetic construct
  source 1..15: mol_type = other RNA
tactttgtgctgaca

SEQ ID NO: 454 - RNA, 15 nt, synthetic construct
  source 1..15: mol_type = other RNA
aattatgaagaccac

SEQ ID NO: 455 - RNA, 15 nt, synthetic construct
  source 1..15: mol_type = other RNA
tctctgagtctctgt

SEQ ID NO: 456 - RNA, 15 nt, synthetic construct
  source 1..15: mol_type = other RNA
tatctggatgtctat

SEQ ID NO: 457 - RNA, 15 nt, synthetic construct
  source 1..15: mol_type = other RNA
tgactcggaaggagg

SEQ ID NO: 458 - RNA, 15 nt, synthetic construct
  source 1..15: mol_type = other RNA
cttcaggctccatga

SEQ ID NO: 459 - RNA, 15 nt, synthetic construct
  source 1..15: mol_type = other RNA
agtgacatatgccac

SEQ ID NO: 460 - RNA, 15 nt, synthetic construct
  source 1..15: mol_type = other RNA
gaacatcaatgcttt

SEQ ID NO: 461 - RNA, 15 nt, synthetic construct
  source 1..15: mol_type = other RNA
actggaggagtgagt

SEQ ID NO: 462 - RNA, 15 nt, synthetic construct
  source 1..15: mol_type = other RNA
aagtcaaggacatct

SEQ ID NO: 463 - RNA, 15 nt, synthetic construct
  source 1..15: mol_type = other RNA
attgaattaaaacag

SEQ ID NO: 464 - RNA, 15 nt, synthetic construct
  source 1..15: mol_type = other RNA
tccatgaacatctac

SEQ ID NO: 465 - RNA, 15 nt, synthetic construct
  source 1..15: mol_type = other RNA
ctttccactgctatg

SEQ ID NO: 466 - RNA, 15 nt, synthetic construct
  source 1..15: mol_type = other RNA
ctgccaagtgaatgg

SEQ ID NO: 467 - RNA, 15 nt, synthetic construct
  source 1..15: mol_type = other RNA
aagtgaacatcaatg

SEQ ID NO: 468 - RNA, 15 nt, synthetic construct
  source 1..15: mol_type = other RNA
tgctgccctggctga

SEQ ID NO: 469 - RNA, 15 nt, synthetic construct
  source 1..15: mol_type = other RNA
gcttggacactgagc

SEQ ID NO: 470 - RNA, 15 nt, synthetic construct
  source 1..15: mol_type = other RNA
aaagccagtctctga

SEQ ID NO: 471 - RNA, 15 nt, synthetic construct
  source 1..15: mol_type = other RNA
aggattatctggatg

SEQ ID NO: 472 - RNA, 15 nt, synthetic construct
  source 1..15: mol_type = other RNA
acttaattgagaagg

SEQ ID NO: 473 - RNA, 15 nt, synthetic construct
  source 1..15: mol_type = other RNA
aggtctaggtctgga

SEQ ID NO: 474 - RNA, 15 nt, synthetic construct
  source 1..15: mol_type = other RNA
tgactatgacgttgc

SEQ ID NO: 475 - RNA, 15 nt, synthetic construct
  source 1..15: mol_type = other RNA
gtcgtttcattcaag

SEQ ID NO: 476 - RNA, 15 nt, synthetic construct
  source 1..15: mol_type = other RNA
tgtgtctgaggagga

SEQ ID NO: 477 - RNA, 15 nt, synthetic construct
  source 1..15: mol_type = other RNA
caatgctttggcttc

SEQ ID NO: 478 - RNA, 15 nt, synthetic construct
  source 1..15: mol_type = other RNA
gagaagtcgtttcat

SEQ ID NO: 479 - RNA, 15 nt, synthetic construct
  source 1..15: mol_type = other RNA
gaagaccacaagttg

SEQ ID NO: 480 - RNA, 15 nt, synthetic construct
  source 1..15: mol_type = other RNA
gaacatctacctggt

SEQ ID NO: 481 - RNA, 15 nt, synthetic construct
  source 1..15: mol_type = other RNA
gtgccagaacacaga

SEQ ID NO: 482 - RNA, 15 nt, synthetic construct
  source 1..15: mol_type = other RNA
gaaggtggcaagtta

SEQ ID NO: 483 - RNA, 15 nt, synthetic construct
  source 1..15: mol_type = other RNA
caagcaaccatggca

SEQ ID NO: 484 - RNA, 15 nt, synthetic construct
  source 1..15: mol_type = other RNA
caggcccatttgtct

SEQ ID NO: 485 - RNA, 15 nt, synthetic construct
  source 1..15: mol_type = other RNA
tgtctagtcaactta

SEQ ID NO: 486 - RNA, 15 nt, synthetic construct
  source 1..15: mol_type = other RNA
ccgcacccgccatgt

SEQ ID NO: 487 - RNA, 15 nt, synthetic construct
  source 1..15: mol_type = other RNA
ttgatgagatccggg

SEQ ID NO: 488 - RNA, 15 nt, synthetic construct
  source 1..15: mol_type = other RNA
tttgaggcttcctcc

SEQ ID NO: 489 - RNA, 15 nt, synthetic construct
  source 1..15: mol_type = other RNA
catgtgttcaaagtc

SEQ ID NO: 490 - RNA, 15 nt, synthetic construct
  source 1..15: mol_type = other RNA
tgtctgaggaggaga

SEQ ID NO: 491 - RNA, 15 nt, synthetic construct
  source 1..15: mol_type = other RNA
gacggagccttcctg

SEQ ID NO: 492 - RNA, 15 nt, synthetic construct
  source 1..15: mol_type = other RNA
aggtgattctggcgg

SEQ ID NO: 493 - RNA, 15 nt, synthetic construct
  source 1..15: mol_type = other RNA
tgagatctctttcca

SEQ ID NO: 494 - RNA, 15 nt, synthetic construct
  source 1..15: mol_type = other RNA
gagatccgggacttg

SEQ ID NO: 495 - RNA, 15 nt, synthetic construct
  source 1..15: mol_type = other RNA
ccctgatcaagctca

SEQ ID NO: 496 - RNA, 15 nt, synthetic construct
  source 1..15: mol_type = other RNA
agacaatgagcaaca

SEQ ID NO: 497 - RNA, 15 nt, synthetic construct
  source 1..15: mol_type = other RNA
gattaccacaagcaa

SEQ ID NO: 498 - RNA, 15 nt, synthetic construct
  source 1..15: mol_type = other RNA
aatgtgagtgatgag

SEQ ID NO: 499 - RNA, 15 nt, synthetic construct
  source 1..15: mol_type = other RNA
cagcttggacactga

SEQ ID NO: 500 - RNA, 15 nt, synthetic construct
  source 1..15: mol_type = other RNA
tacatcaagaatggg

SEQ ID NO: 501 - RNA, 15 nt, synthetic construct
  source 1..15: mol_type = other RNA
agcagcacattgttt

SEQ ID NO: 502 - RNA, 15 nt, synthetic construct
  source 1..15: mol_type = other RNA
cacaagttgaagtca

SEQ ID NO: 503 - RNA, 14 nt, synthetic construct
  source 1..14: mol_type = other RNA
agtctctgtggcaa

SEQ ID NO: 504 - RNA, 11 nt, synthetic construct
  source 1..11: mol_type = other RNA
gtttcattcaa

SEQ ID NO: 505 - RNA, 34 nt, synthetic construct
  source 1..34: mol_type = other RNA
tagaaaacccaaatcctcagatttgggttttcta

SEQ ID NO: 506 - RNA, 34 nt, synthetic construct
  source 1..34: mol_type = other RNA
tctgtctgatccatctagcgatggatcagacaga

SEQ ID NO: 507 - RNA, 34 nt, synthetic construct
  source 1..34: mol_type = other RNA
taccatgccacagagactcctctgtggcatggta

SEQ ID NO: 508 - RNA, 34 nt, synthetic construct
  source 1..34: mol_type = other RNA
tatccatctagcaccaggtggtgctagatggata

SEQ ID NO: 509 - RNA, 34 nt, synthetic construct
  source 1..34: mol_type = other RNA
taaacccaaatcctcatctgaggatttgggttta

SEQ ID NO: 510 - RNA, 34 nt, synthetic construct
  source 1..34: mol_type = other RNA
tccatctagcaccaggtagctggtgctagatgga

SEQ ID NO: 511 - RNA, 34 nt, synthetic construct
  source 1..34: mol_type = other RNA
taaaacccaaatcctcatcaggatttgggtttta

SEQ ID NO: 512 - RNA, 34 nt, synthetic construct
  source 1..34: mol_type = other RNA
tgtctgatccatctagcactagatggatcagaca

SEQ ID NO: 513 - RNA, 34 nt, synthetic construct
  source 1..34: mol_type = other RNA
tacccaaatcctcatcttgatgaggatttgggta

SEQ ID NO: 514 - RNA, 34 nt, synthetic construct
  source 1..34: mol_type = other RNA
ttccatctagcaccaggtatggtgctagatggaa

SEQ ID NO: 515 - RNA, 34 nt, synthetic construct
  source 1..34: mol_type = other RNA
taacccaaatcctcatctttgaggatttgggtta

SEQ ID NO: 516 - RNA, 34 nt, synthetic construct
  source 1..34: mol_type = other RNA
tcatgccacagagactcaggtctctgtggcatga

SEQ ID NO: 517 - RNA, 34 nt, synthetic construct
  source 1..34: mol_type = other RNA
ttgccacagagactcagaggagtctctgtggcaa

SEQ ID NO: 518 - RNA, 34 nt, synthetic construct
  source 1..34: mol_type = other RNA
tatgatgacatggcgggtgcgccatgtcatcata

SEQ ID NO: 519 - RNA, 34 nt, synthetic construct
  source 1..34: mol_type = other RNA
ttccatatccttgactttggtcaaggatatggaa

SEQ ID NO: 520 - RNA, 34 nt, synthetic construct
  source 1..34: mol_type = other RNA
tacaccaacttgaatgaaaattcaagttggtgta

SEQ ID NO: 521 - RNA, 34 nt, synthetic construct
  source 1..34: mol_type = other RNA
tgccacagagactcagagatgagtctctgtggca

SEQ ID NO: 522 - RNA, 34 nt, synthetic construct
  source 1..34: mol_type = other RNA
tccatgccacagagactcatctctgtggcatgga

SEQ ID NO: 523 - RNA, 34 nt, synthetic construct
  source 1..34: mol_type = other RNA
tcatctagcaccaggtagacctggtgctagatga

SEQ ID NO: 524 - RNA, 34 nt, synthetic construct
  source 1..34: mol_type = other RNA
tttccatatccttgacttttcaaggatatggaaa

SEQ ID NO: 525 - RNA, 34 nt, synthetic construct
  source 1..34: mol_type = other RNA
tgatccatctagcaccagggtgctagatggatca

SEQ ID NO: 526 - RNA, 34 nt, synthetic construct
  source 1..34: mol_type = other RNA
tccacagagactcagagacctgagtctctgtgga

SEQ ID NO: 527 - RNA, 34 nt, synthetic construct
  source 1..34: mol_type = other RNA
ttgatccatctagcaccagtgctagatggatcaa

SEQ ID NO: 528 - RNA, 34 nt, synthetic construct
  source 1..34: mol_type = other RNA
tacctccttccgagtcagcactcggaaggaggta

SEQ ID NO: 529 - RNA, 34 nt, synthetic construct
  source 1..34: mol_type = other RNA
ttctgatccatctagcaccctagatggatcagaa

SEQ ID NO: 530 - RNA, 34 nt, synthetic construct
  source 1..34: mol_type = other RNA
ttcttggcaggaaggctccccttcctgccaagaa

SEQ ID NO: 531 - RNA, 34 nt, synthetic construct
  source 1..34: mol_type = other RNA
ttctagcaccaggtagatgtacctggtgctagaa

SEQ ID NO: 532 - RNA, 34 nt, synthetic construct
  source 1..34: mol_type = other RNA
taagtactcagacaccacagtgtctgagtactta

SEQ ID NO: 533 - RNA, 34 nt, synthetic construct
  source 1..34: mol_type = other RNA
ttgtctgatccatctagcaagatggatcagacaa

SEQ ID NO: 534 - RNA, 34 nt, synthetic construct
  source 1..34: mol_type = other RNA
tatctagcaccaggtagatacctggtgctagata

SEQ ID NO: 535 - RNA, 34 nt, synthetic construct
  source 1..34: mol_type = other RNA
tcaaatcctcatcttggagaagatgaggatttga

SEQ ID NO: 536 - RNA, 34 nt, synthetic construct
  source 1..34: mol_type = other RNA
tatagtcataaaattcaggaattttatgactata

SEQ ID NO: 537 - RNA, 34 nt, synthetic construct
  source 1..34: mol_type = other RNA
taggatgatgacatggcggcatgtcatcatccta

SEQ ID NO: 538 - RNA, 34 nt, synthetic construct
  source 1..34: mol_type = other RNA
tcaatctgtgttctggcaccagaacacagattga

SEQ ID NO: 539 - RNA, 34 nt, synthetic construct
  source 1..34: mol_type = other RNA
ttgagcttgatcagggcaacctgatcaagctcaa

SEQ ID NO: 540 - RNA, 34 nt, synthetic construct
  source 1..34: mol_type = other RNA
tagtggaaagagatctcatgatctctttccacta

SEQ ID NO: 541 - RNA, 34 nt, synthetic construct
  source 1..34: mol_type = other RNA
tagatgttcatggagcctgctccatgaacatcta

SEQ ID NO: 542 - RNA, 34 nt, synthetic construct
  source 1..34: mol_type = other RNA
tgcaagtggtagttggaggcaactaccacttgca

SEQ ID NO: 543 - RNA, 34 nt, synthetic construct
  source 1..34: mol_type = other RNA
tcacaccataacttgccaccaagttatggtgtga

SEQ ID NO: 544 - RNA, 34 nt, synthetic construct
  source 1..34: mol_type = other RNA
taaagagatctcatcactcgatgagatctcttta

SEQ ID NO: 545 - RNA, 34 nt, synthetic construct
  source 1..34: mol_type = other RNA
ttcaacttgtggtcttcatagaccacaagttgaa

SEQ ID NO: 546 - RNA, 34 nt, synthetic construct
  source 1..34: mol_type = other RNA
taaacgacttctcttgtgaaagagaagtcgttta

SEQ ID NO: 547 - RNA, 34 nt, synthetic construct
  source 1..34: mol_type = other RNA
tgtatgtggcatatgtcaccatatgccacataca

SEQ ID NO: 548 - RNA, 34 nt, synthetic construct
  source 1..34: mol_type = other RNA
tgtctttcttggaagccaacttccaagaaagaca

SEQ ID NO: 549 - RNA, 34 nt, synthetic construct
  source 1..34: mol_type = other RNA
tcatccagataatcctcccggattatctggatga

SEQ ID NO: 550 - RNA, 34 nt, synthetic construct
  source 1..34: mol_type = other RNA
tttgactttgtcatagccttatgacaaagtcaaa

SEQ ID NO: 551 - RNA, 34 nt, synthetic construct
  source 1..34: mol_type = other RNA
taaactccagacctagacctaggtctggagttta

SEQ ID NO: 552 - RNA, 34 nt, synthetic construct
  source 1..34: mol_type = other RNA
tataacttgccaccttctcaggtggcaagttata

SEQ ID NO: 553 - RNA, 34 nt, synthetic construct
  source 1..34: mol_type = other RNA
tcatagtcataaaattcagattttatgactatga

SEQ ID NO: 554 - RNA, 34 nt, synthetic construct
  source 1..34: mol_type = other RNA
ttggctcctgtgaagttgccttcacaggagccaa

SEQ ID NO: 555 - RNA, 34 nt, synthetic construct
  source 1..34: mol_type = other RNA
taaagtactcagacaccactgtctgagtacttta

SEQ ID NO: 556 - RNA, 34 nt, synthetic construct
  source 1..34: mol_type = other RNA
tgctcattgtctttcttgggaaagacaatgagca

SEQ ID NO: 557 - RNA, 34 nt, synthetic construct
  source 1..34: mol_type = other RNA
ttaaaattcaggaattcctattcctgaattttaa

SEQ ID NO: 558 - RNA, 34 nt, synthetic construct
  source 1..34: mol_type = other RNA
tgagatcttggcctgccatcaggccaagatctca

SEQ ID NO: 559 - RNA, 34 nt, synthetic construct
  source 1..34: mol_type = other RNA
tgagcatctctctcacagctgagagagatgctca

SEQ ID NO: 560 - RNA, 34 nt, synthetic construct
  source 1..34: mol_type = other RNA
taaccgtcatagcagtggactgctatgacggtta

SEQ ID NO: 561 - RNA, 34 nt, synthetic construct
  source 1..34: mol_type = other RNA
tagagctttgatatcctgtgatatcaaagctcta

SEQ ID NO: 562 - RNA, 34 nt, synthetic construct
  source 1..34: mol_type = other RNA
tacaatgtgctgctgtcagcagcagcacattgta

SEQ ID NO: 563 - RNA, 34 nt, synthetic construct
  source 1..34: mol_type = other RNA
tggtacgggtagaagccagcttctacccgtacca

SEQ ID NO: 564 - RNA, 34 nt, synthetic construct
  source 1..34: mol_type = other RNA
tcagacctagacctggtcacaggtctaggtctga

SEQ ID NO: 565 - RNA, 34 nt, synthetic construct
  source 1..34: mol_type = other RNA
tttctcttgtgaactatcaagttcacaagagaaa

SEQ ID NO: 566 - RNA, 34 nt, synthetic construct
  source 1..34: mol_type = other RNA
tttcaggaattcctgcttccaggaattcctgaaa

SEQ ID NO: 567 - RNA, 34 nt, synthetic construct
  source 1..34: mol_type = other RNA
tccaggttttccatatccttatggaaaacctgga

SEQ ID NO: 568 - RNA, 34 nt, synthetic construct
  source 1..34: mol_type = other RNA
tcaacttgaatgaaacgactttcattcaagttga

SEQ ID NO: 569 - RNA, 34 nt, synthetic construct
  source 1..34: mol_type = other RNA
tgtgctgctgtcagcacaagctgacagcagcaca

SEQ ID NO: 570 - RNA, 34 nt, synthetic construct
  source 1..34: mol_type = other RNA
tgacctccttccgagtcagctcggaaggaggtca

SEQ ID NO: 571 - RNA, 34 nt, synthetic construct
  source 1..34: mol_type = other RNA
tcaattaagttgactagacagtcaacttaattga

SEQ ID NO: 572 - RNA, 34 nt, synthetic construct
  source 1..34: mol_type = other RNA
ttgacacgttcgccgctggcggcgaacgtgtcaa

SEQ ID NO: 573 - RNA, 34 nt, synthetic construct
  source 1..34: mol_type = other RNA
tcattgtctttcttggaagcaagaaagacaatga

SEQ ID NO: 574 - RNA, 34 nt, synthetic construct
  source 1..34: mol_type = other RNA
tccaacttgaatgaaacgattcattcaagttgga

SEQ ID NO: 575 - RNA, 34 nt, synthetic construct
  source 1..34: mol_type = other RNA
tcacaaagtactcagacacctgagtactttgtga

SEQ ID NO: 576 - RNA, 34 nt, synthetic construct
  source 1..34: mol_type = other RNA
ttgcagtggtaggtgacgccacctaccactgcaa

SEQ ID NO: 577 - RNA, 34 nt, synthetic construct
  source 1..34: mol_type = other RNA
ttcatgaggatgatgacatcatcatcctcatgaa

SEQ ID NO: 578 - RNA, 34 nt, synthetic construct
  source 1..34: mol_type = other RNA
tttcaacttgtggtcttcagaccacaagttgaaa

SEQ ID NO: 579 - RNA, 34 nt, synthetic construct
  source 1..34: mol_type = other RNA
tgtagttggaggaagcctccttcctccaactaca

SEQ ID NO: 580 - RNA, 34 nt, synthetic construct
  source 1..34: mol_type = other RNA
tcatgctgtacactgcctgcagtgtacagcatga

SEQ ID NO: 581 - RNA, 34 nt, synthetic construct
  source 1..34: mol_type = other RNA
ttgtctttcttggaagccattccaagaaagacaa

SEQ ID NO: 582 - RNA, 34 nt, synthetic construct
  source 1..34: mol_type = other RNA
tcgactccttctatggtctcatagaaggagtcga

SEQ ID NO: 583 - RNA, 34 nt, synthetic construct
  source 1..34: mol_type = other RNA
tgacatccagataatcctcattatctggatgtca

SEQ ID NO: 584 - RNA, 34 nt, synthetic construct
  source 1..34: mol_type = other RNA
ttgagatcttggcctgccaaggccaagatctcaa

SEQ ID NO: 585 - RNA, 34 nt, synthetic construct
  source 1..34: mol_type = other RNA
tacgctgtcttcaaggcggcttgaagacagcgta

SEQ ID NO: 586 - RNA, 34 nt, synthetic construct
  source 1..34: mol_type = other RNA
tagacaggaaagcttcggcaagctttcctgtcta

SEQ ID NO: 587 - RNA, 34 nt, synthetic construct
  source 1..34: mol_type = other RNA
tttgaacacatgttgctcacaacatgtgttcaaa

SEQ ID NO: 588 - RNA, 34 nt, synthetic construct
  source 1..34: mol_type = other RNA
tataaaattcaggaattccttcctgaattttata

SEQ ID NO: 589 - RNA, 34 nt, synthetic construct
  source 1..34: mol_type = other RNA
tcccaaatcctcatcttgggatgaggatttggga

SEQ ID NO: 590 - RNA, 34 nt, synthetic construct
  source 1..34: mol_type = other RNA
taagagatctcatcactcatgatgagatctctta

SEQ ID NO: 591 - RNA, 34 nt, synthetic construct
  source 1..34: mol_type = other RNA
taaagcattgatgttcactaacatcaatgcttta

SEQ ID NO: 592 - RNA, 34 nt, synthetic construct
  source 1..34: mol_type = other RNA
taggaattcctgcttctttaagcaggaattccta

SEQ ID NO: 593 - RNA, 34 nt, synthetic construct
  source 1..34: mol_type = other RNA
tatgaaggagtcttggcagcaagactccttcata

SEQ ID NO: 594 - RNA, 34 nt, synthetic construct
  source 1..34: mol_type = other RNA
taagcttcggccacctcttggtggccgaagctta

SEQ ID NO: 595 - RNA, 34 nt, synthetic construct
  source 1..34: mol_type = other RNA
ttgactttgtcatagcctgctatgacaaagtcaa

SEQ ID NO: 596 - RNA, 34 nt, synthetic construct
  source 1..34: mol_type = other RNA
ttccaagctgaaactccagagtttcagcttggaa

SEQ ID NO: 597 - RNA, 34 nt, synthetic construct
  source 1..34: mol_type = other RNA
tccaaatcctcatcttggaagatgaggatttgga

SEQ ID NO: 598 - RNA, 34 nt, synthetic construct
  source 1..34: mol_type = other RNA
tcagctgttttaattcaataattaaaacagctga

SEQ ID NO: 599 - RNA, 34 nt, synthetic construct
  source 1..34: mol_type = other RNA
taacgacttctcttgtgaacaagagaagtcgtta

SEQ ID NO: 600 - RNA, 34 nt, synthetic construct
  source 1..34: mol_type = other RNA
tccggaacatccaagcgggcttggatgttccgga

SEQ ID NO: 601 - RNA, 34 nt, synthetic construct
  source 1..34: mol_type = other RNA
tcaaacacatagacatccatgtctatgtgtttga

SEQ ID NO: 602 - RNA, 34 nt, synthetic construct
  source 1..34: mol_type = other RNA
tttcacaccataacttgccagttatggtgtgaaa

SEQ ID NO: 603 - RNA, 34 nt, synthetic construct
  source 1..34: mol_type = other RNA
ttctcttgtgaactatcaatagttcacaagagaa

SEQ ID NO: 604 - RNA, 34 nt, synthetic construct
  source 1..34: mol_type = other RNA
tattcaggaattcctgcttaggaattcctgaata

SEQ ID NO: 605 - RNA, 34 nt, synthetic construct
  source 1..34: mol_type = other RNA
tgacactttgacccaaatttgggtcaaagtgtca

SEQ ID NO: 606 - RNA, 34 nt, synthetic construct
  source 1..34: mol_type = other RNA
tcacaaacagagctttgataagctctgtttgtga

SEQ ID NO: 607 - RNA, 34 nt, synthetic construct
  source 1..34: mol_type = other RNA
tcaaacagagctttgatatcaaagctctgtttga

SEQ ID NO: 608 - RNA, 34 nt, synthetic construct
  source 1..34: mol_type = other RNA
tttggagtttctccttcagaggagaaactccaaa

SEQ ID NO: 609 - RNA, 34 nt, synthetic construct
  source 1..34: mol_type = other RNA
ttcacaccataacttgccaaagttatggtgtgaa

SEQ ID NO: 610 - RNA, 34 nt, synthetic construct
  source 1..34: mol_type = other RNA
ttgaatgaaacgacttctcagtcgtttcattcaa

SEQ ID NO: 611 - RNA, 34 nt, synthetic construct
  source 1..34: mol_type = other RNA
tcaggttttccatatccttatatggaaaacctga

SEQ ID NO: 612 - RNA, 34 nt, synthetic construct
  source 1..34: mol_type = other RNA
tgcatctctctcacagctgtgtgagagagatgca

SEQ ID NO: 613 - RNA, 34 nt, synthetic construct
  source 1..34: mol_type = other RNA
tacatccagataatcctccgattatctggatgta

SEQ ID NO: 614 - RNA, 34 nt, synthetic construct
  source 1..34: mol_type = other RNA
tcgagttgttccctcggtggagggaacaactcga

SEQ ID NO: 615 - RNA, 34 nt, synthetic construct
  source 1..34: mol_type = other RNA
tacacatgttgctcattgttgagcaacatgtgta

SEQ ID NO: 616 - RNA, 34 nt, synthetic construct
  source 1..34: mol_type = other RNA
ttctcaattaagttgactacaacttaattgagaa

SEQ ID NO: 617 - RNA, 34 nt, synthetic construct
  source 1..34: mol_type = other RNA
tgaagccaaagcattgatgaatgctttggcttca

SEQ ID NO: 618 - RNA, 34 nt, synthetic construct
  source 1..34: mol_type = other RNA
tgcagtggaaagagatctctctctttccactgca

SEQ ID NO: 619 - RNA, 34 nt, synthetic construct
  source 1..34: mol_type = other RNA
tacactgcctggagggcctcctccaggcagtgta

SEQ ID NO: 620 - RNA, 34 nt, synthetic construct
  source 1..34: mol_type = other RNA
ttagacctggtcacattcctgtgaccaggtctaa

SEQ ID NO: 621 - RNA, 34 nt, synthetic construct
  source 1..34: mol_type = other RNA
tcagacacaaacagagctttctgtttgtgtctga

SEQ ID NO: 622 - RNA, 34 nt, synthetic construct
  source 1..34: mol_type = other RNA
tgagtttctccttcagccatgaaggagaaactca

SEQ ID NO: 623 - RNA, 34 nt, synthetic construct
  source 1..34: mol_type = other RNA
tatgtgctgctgtcagcactgacagcagcacata

SEQ ID NO: 624 - RNA, 34 nt, synthetic construct
  source 1..34: mol_type = other RNA
tcagagctttgatatcctgatatcaaagctctga

SEQ ID NO: 625 - RNA, 34 nt, synthetic construct
  source 1..34: mol_type = other RNA
tgatatcctgtgcagggagctgcacaggatatca

SEQ ID NO: 626 - RNA, 34 nt, synthetic construct
  source 1..34: mol_type = other RNA
tagggcaacgtcatagtcatatgacgttgcccta

SEQ ID NO: 627 - RNA, 34 nt, synthetic construct
  source 1..34: mol_type = other RNA
tagacctagacctggtcacccaggtctaggtcta

SEQ ID NO: 628 - RNA, 34 nt, synthetic construct
  source 1..34: mol_type = other RNA
tagtactcagacaccacagggtgtctgagtacta

SEQ ID NO: 629 - RNA, 34 nt, synthetic construct
  source 1..34: mol_type = other RNA
taaggctccgtcccgctcccgggacggagcctta

SEQ ID NO: 630 - RNA, 34 nt, synthetic construct
  source 1..34: mol_type = other RNA
tgggcaacgtcatagtcatctatgacgttgccca

SEQ ID NO: 631 - RNA, 34 nt, synthetic construct
  source 1..34: mol_type = other RNA
tctgttttaattcaatcccttgaattaaaacaga

SEQ ID NO: 632 - RNA, 34 nt, synthetic construct
  source 1..34: mol_type = other RNA
tagagatctcatcactcacgtgatgagatctcta

SEQ ID NO: 633 - RNA, 34 nt, synthetic construct
  source 1..34: mol_type = other RNA
tggtcttcataattgatttcaattatgaagacca

SEQ ID NO: 634 - RNA, 34 nt, synthetic construct
  source 1..34: mol_type = other RNA
tcatatcttggcttcacacgaagccaagatatga

SEQ ID NO: 635 - RNA, 34 nt, synthetic construct
  source 1..34: mol_type = other RNA
tcaccaacttgaatgaaaccattcaagttggtga

SEQ ID NO: 636 - RNA, 34 nt, synthetic construct
  source 1..34: mol_type = other RNA
tagctgttttaattcaatcgaattaaaacagcta

SEQ ID NO: 637 - RNA, 34 nt, synthetic construct
  source 1..34: mol_type = other RNA
ttaacttgccaccttctcaaaggtggcaagttaa

SEQ ID NO: 638 - RNA, 34 nt, synthetic construct
  source 1..34: mol_type = other RNA
ttgagcaggtacctgctttcaggtacctgctcaa

SEQ ID NO: 639 - RNA, 34 nt, synthetic construct
  source 1..34: mol_type = other RNA
tttgatgtagacctccttcgaggtctacatcaaa

SEQ ID NO: 640 - RNA, 34 nt, synthetic construct
  source 1..34: mol_type = other RNA
tggcaagtggtagttggagaactaccacttgcca

SEQ ID NO: 641 - RNA, 34 nt, synthetic construct
  source 1..34: mol_type = other RNA
tggaagcctcaaagctcgagctttgaggcttcca

SEQ ID NO: 642 - RNA, 34 nt, synthetic construct
  source 1..34: mol_type = other RNA
taatgacagtaattgggtccaattactgtcatta

SEQ ID NO: 643 - RNA, 34 nt, synthetic construct
  source 1..34: mol_type = other RNA
ttttgaacacatgttgctcaacatgtgttcaaaa

SEQ ID NO: 644 - RNA, 34 nt, synthetic construct
  source 1..34: mol_type = other RNA
taaatcctcatcttggagtcaagatgaggattta

SEQ ID NO: 645 - RNA, 34 nt, synthetic construct
  source 1..34: mol_type = other RNA
tggagtttctccttcagccgaaggagaaactcca

SEQ ID NO: 646 - RNA, 34 nt, synthetic construct
  source 1..34: mol_type = other RNA
tcataacttgccaccttctggtggcaagttatga

SEQ ID NO: 647 - RNA, 34 nt, synthetic construct
  source 1..34: mol_type = other RNA
tgctgttttaattcaatcctgaattaaaacagca

SEQ ID NO: 648 - RNA, 34 nt, synthetic construct
  source 1..34: mol_type = other RNA
taagctcgagttgttccctaacaactcgagctta

SEQ ID NO: 649 - RNA, 34 nt, synthetic construct
  source 1..34: mol_type = other RNA
tggcaacgtcatagtcataactatgacgttgcca

SEQ ID NO: 650 - RNA, 34 nt, synthetic construct
  source 1..34: mol_type = other RNA
tttccaggttttccatatctggaaaacctggaaa

SEQ ID NO: 651 - RNA, 34 nt, synthetic construct
  source 1..34: mol_type = other RNA
ttccaggttttccatatccatggaaaacctggaa

SEQ ID NO: 652 - RNA, 34 nt, synthetic construct
  source 1..34: mol_type = other RNA
tccatgttgtgcaatccatattgcacaacatgga

SEQ ID NO: 653 - RNA, 34 nt, synthetic construct
  source 1..34: mol_type = other RNA
tcatatccttgactttgaaaagtcaaggatatga

SEQ ID NO: 654 - RNA, 34 nt, synthetic construct
  source 1..34: mol_type = other RNA
ttgactttgaacacatgtttgtgttcaaagtcaa

SEQ ID NO: 655 - RNA, 34 nt, synthetic construct
  source 1..34: mol_type = other RNA
tctcatcttggagtttctcaactccaagatgaga

SEQ ID NO: 656 - RNA, 34 nt, synthetic construct
  source 1..34: mol_type = other RNA
tcatgttgctcattgtcttcaatgagcaacatga

SEQ ID NO: 657 - RNA, 34 nt, synthetic construct
  source 1..34: mol_type = other RNA
taccaacttgaatgaaacgtcattcaagttggta

SEQ ID NO: 658 - RNA, 34 nt, synthetic construct
  source 1..34: mol_type = other RNA
tacagatcgctgtctgcccagacagcgatctgta

SEQ ID NO: 659 - RNA, 34 nt, synthetic construct
  source 1..34: mol_type = other RNA
ttcacagctgcctttcttaaaaggcagctgtgaa

SEQ ID NO: 660 - RNA, 34 nt, synthetic construct
  source 1..34: mol_type = other RNA
tggccgccagaatcacctctgattctggcggcca

SEQ ID NO: 661 - RNA, 34 nt, synthetic construct
  source 1..34: mol_type = other RNA
tccaagctgaaactccagagagtttcagcttgga

SEQ ID NO: 662 - RNA, 34 nt, synthetic construct
  source 1..34: mol_type = other RNA
tttgatcagggcaacgtcagttgccctgatcaaa

SEQ ID NO: 663 - RNA, 34 nt, synthetic construct
  source 1..34: mol_type = other RNA
tgttcccaaaccatgccaccatggtttgggaaca

SEQ ID NO: 664 - RNA, 34 nt, synthetic construct
  source 1..34: mol_type = other RNA
tacctgcttttgccgcttccggcaaaagcaggta

SEQ ID NO: 665 - RNA, 34 nt, synthetic construct
  source 1..34: mol_type = other RNA
tttgctcattgtctttcttaagacaatgagcaaa

SEQ ID NO: 666 - RNA, 34 nt, synthetic construct
  source 1..34: mol_type = other RNA
tcacgttcgccgctgggagcagcggcgaacgtga

SEQ ID NO: 667 - RNA, 34 nt, synthetic construct
  source 1..34: mol_type = other RNA
tcattcttgatgtagacctctacatcaagaatga

SEQ ID NO: 668 - RNA, 34 nt, synthetic construct
  source 1..34: mol_type = other RNA
tttgagcttgatcagggcactgatcaagctcaaa

SEQ ID NO: 669 - RNA, 34 nt, synthetic construct
  source 1..34: mol_type = other RNA
tattcttgatgtagacctctctacatcaagaata

SEQ ID NO: 670 - RNA, 34 nt, synthetic construct
  source 1..34: mol_type = other RNA
ttgaaggagtcttggcaggccaagactccttcaa

SEQ ID NO: 671 - RNA, 34 nt, synthetic construct
  source 1..34: mol_type = other RNA
tttggcttcacaccataactggtgtgaagccaaa

SEQ ID NO: 672 - RNA, 34 nt, synthetic construct
  source 1..34: mol_type = other RNA
tatcttggcttcacaccattgtgaagccaagata

SEQ ID NO: 673 - RNA, 34 nt, synthetic construct
  source 1..34: mol_type = other RNA
tctcacagctgcctttcttaaggcagctgtgaga

SEQ ID NO: 674 - RNA, 34 nt, synthetic construct
  source 1..34: mol_type = other RNA
tccaatgctgtctgatccatcagacagcattgga

SEQ ID NO: 675 - RNA, 34 nt, synthetic construct
  source 1..34: mol_type = other RNA
tgagtggtggtcacacctctgtgaccaccactca

SEQ ID NO: 676 - RNA, 34 nt, synthetic construct
  source 1..34: mol_type = other RNA
tatagggactcactcctccgagtgagtccctata

SEQ ID NO: 677 - RNA, 34 nt, synthetic construct
  source 1..34: mol_type = other RNA
tctgacttcaacttgtggtcaagttgaagtcaga

SEQ ID NO: 678 - RNA, 34 nt, synthetic construct
  source 1..34: mol_type = other RNA
tttctcaattaagttgactaacttaattgagaaa

SEQ ID NO: 679 - RNA, 34 nt, synthetic construct
  source 1..34: mol_type = other RNA
tagtttctccttcagccagctgaaggagaaacta

SEQ ID NO: 680 - RNA, 34 nt, synthetic construct
  source 1..34: mol_type = other RNA
tagctttgatatcctgtgcaggatatcaaagcta

SEQ ID NO: 681 - RNA, 34 nt, synthetic construct
  source 1..34: mol_type = other RNA
ttgtccttgactttgtcatcaaagtcaaggacaa

SEQ ID NO: 682 - RNA, 34 nt, synthetic construct
  source 1..34: mol_type = other RNA
tcaggtacgtgtctgcacacagacacgtacctga

SEQ ID NO: 683 - RNA, 34 nt, synthetic construct
  source 1..34: mol_type = other RNA
taaacaatgtgctgctgtcgcagcacattgttta

SEQ ID NO: 684 - RNA, 34 nt, synthetic construct
  source 1..34: mol_type = other RNA
tatatcctgtgcagggagccctgcacaggatata

SEQ ID NO: 685 - RNA, 34 nt, synthetic construct
  source 1..34: mol_type = other RNA
tgactcagagactggctttccagtctctgagtca

SEQ ID NO: 686 - RNA, 34 nt, synthetic construct
  source 1..34: mol_type = other RNA
tcaatgacagtaattgggtaattactgtcattga

SEQ ID NO: 687 - RNA, 34 nt, synthetic construct
  source 1..34: mol_type = other RNA
tgagccaccttcctgacaccaggaaggtggctca

SEQ ID NO: 688 - RNA, 34 nt, synthetic construct
  source 1..34: mol_type = other RNA
tcttgactttgaacacatgtgttcaaagtcaaga

SEQ ID NO: 689 - RNA, 34 nt, synthetic construct
  source 1..34: mol_type = other RNA
tatgaaacgacttctcttgagaagtcgtttcata

SEQ ID NO: 690 - RNA, 34 nt, synthetic construct
  source 1..34: mol_type = other RNA
tgaagacaggaaagcttcggctttcctgtcttca

SEQ ID NO: 691 - RNA, 34 nt, synthetic construct
  source 1..34: mol_type = other RNA
tgctttgatatcctgtgcacaggatatcaaagca

SEQ ID NO: 692 - RNA, 34 nt, synthetic construct
  source 1..34: mol_type = other RNA
ttcttgagcttgatcaggggatcaagctcaagaa

SEQ ID NO: 693 - RNA, 34 nt, synthetic construct
  source 1..34: mol_type = other RNA
tggattgctctgcactctggtgcagagcaatcca

SEQ ID NO: 694 - RNA, 34 nt, synthetic construct
  source 1..34: mol_type = other RNA
tcatattgagcatctctctagatgctcaatatga

SEQ ID NO: 695 - RNA, 34 nt, synthetic construct
  source 1..34: mol_type = other RNA
tatccttgactttgaacactcaaagtcaaggata

SEQ ID NO: 696 - RNA, 34 nt, synthetic construct
  source 1..34: mol_type = other RNA
tgcagacatccactactcctagtggatgtctgca

SEQ ID NO: 697 - RNA, 34 nt, synthetic construct
  source 1..34: mol_type = other RNA
tagacctccttccgagtcatcggaaggaggtcta

SEQ ID NO: 698 - RNA, 34 nt, synthetic construct
  source 1..34: mol_type = other RNA
taccttctcaattaagttgttaattgagaaggta

SEQ ID NO: 699 - RNA, 34 nt, synthetic construct
  source 1..34: mol_type = other RNA
tagaagtcggaaggagccgtccttccgacttcta

SEQ ID NO: 700 - RNA, 34 nt, synthetic construct
  source 1..34: mol_type = other RNA
ttgcacagggtacgggtagccgtaccctgtgcaa

SEQ ID NO: 701 - RNA, 34 nt, synthetic construct
  source 1..34: mol_type = other RNA
tatgacagtaattgggtccccaattactgtcata

SEQ ID NO: 702 - RNA, 34 nt, synthetic construct
  source 1..34: mol_type = other RNA
tgttagtccctgacttcaaagtcagggactaaca

SEQ ID NO: 703 - RNA, 34 nt, synthetic construct
  source 1..34: mol_type = other RNA
tatatccttgactttgaacaaagtcaaggatata

SEQ ID NO: 704 - RNA, 34 nt, synthetic construct
  source 1..34: mol_type = other RNA
tgtacgtgtctgcacaggggtgcagacacgtaca

SEQ ID NO: 705 - RNA, 34 nt, synthetic construct
  source 1..34: mol_type = other RNA
tgtcagcacaaagtactcatactttgtgctgaca

SEQ ID NO: 706 - RNA, 34 nt, synthetic construct
  source 1..34: mol_type = other RNA
ttggtcttcataattgattaattatgaagaccaa

SEQ ID NO: 707 - RNA, 34 nt, synthetic construct
  source 1..34: mol_type = other RNA
tcagagactcagagactggtctctgagtctctga

SEQ ID NO: 708 - RNA, 34 nt, synthetic construct
  source 1..34: mol_type = other RNA
ttagacatccagataatcctatctggatgtctaa

SEQ ID NO: 709 - RNA, 34 nt, synthetic construct
  source 1..34: mol_type = other RNA
tctccttccgagtcagctttgactcggaaggaga

SEQ ID NO: 710 - RNA, 34 nt, synthetic construct
  source 1..34: mol_type = other RNA
tcatggagcctgaagggtccttcaggctccatga

SEQ ID NO: 711 - RNA, 34 nt, synthetic construct
  source 1..34: mol_type = other RNA
ttggcatatgtcactagacagtgacatatgccaa

SEQ ID NO: 712 - RNA, 34 nt, synthetic construct
  source 1..34: mol_type = other RNA
taagcattgatgttcacttgaacatcaatgctta

SEQ ID NO: 713 - RNA, 34 nt, synthetic construct
  source 1..34: mol_type = other RNA
tctcactcctccagtacaaactggaggagtgaga

SEQ ID NO: 714 - RNA, 34 nt, synthetic construct
  source 1..34: mol_type = other RNA
tgatgtccttgactttgtcaagtcaaggacatca

SEQ ID NO: 715 - RNA, 34 nt, synthetic construct
  source 1..34: mol_type = other RNA
ttgttttaattcaatcccaattgaattaaaacaa

SEQ ID NO: 716 - RNA, 34 nt, synthetic construct
  source 1..34: mol_type = other RNA
ttagatgttcatggagccttccatgaacatctaa

SEQ ID NO: 717 - RNA, 34 nt, synthetic construct
  source 1..34: mol_type = other RNA
tatagcagtggaaagagatctttccactgctata

SEQ ID NO: 718 - RNA, 34 nt, synthetic construct
  source 1..34: mol_type = other RNA
tcattcacttggcaggtgcctgccaagtgaatga

SEQ ID NO: 719 - RNA, 34 nt, synthetic construct
  source 1..34: mol_type = other RNA
tattgatgttcacttggttaagtgaacatcaata

SEQ ID NO: 720 - RNA, 34 nt, synthetic construct
  source 1..34: mol_type = other RNA
tcagccagggcagcacttgtgctgccctggctga

SEQ ID NO: 721 - RNA, 34 nt, synthetic construct
  source 1..34: mol_type = other RNA
tctcagtgtccaagctgaagcttggacactgaga

SEQ ID NO: 722 - RNA, 34 nt, synthetic construct
  source 1..34: mol_type = other RNA
tcagagactggctttcatcaaagccagtctctga

SEQ ID NO: 723 - RNA, 34 nt, synthetic construct
  source 1..34: mol_type = other RNA
tatccagataatcctccctaggattatctggata

SEQ ID NO: 724 - RNA, 34 nt, synthetic construct
  source 1..34: mol_type = other RNA
tcttctcaattaagttgacacttaattgagaaga

SEQ ID NO: 725 - RNA, 34 nt, synthetic construct
  source 1..34: mol_type = other RNA
tccagacctagacctggtcaggtctaggtctgga

SEQ ID NO: 726 - RNA, 34 nt, synthetic construct
  source 1..34: mol_type = other RNA
tcaacgtcatagtcataaatgactatgacgttga

SEQ ID NO: 727 - RNA, 34 nt, synthetic construct
  source 1..34: mol_type = other RNA
tttgaatgaaacgacttctgtcgtttcattcaaa

SEQ ID NO: 728 - RNA, 34 nt, synthetic construct
  source 1..34: mol_type = other RNA
tcctcctcagacacaaacatgtgtctgaggagga

SEQ ID NO: 729 - RNA, 34 nt, synthetic construct
  source 1..34: mol_type = other RNA
taagccaaagcattgatgtcaatgctttggctta

SEQ ID NO: 730 - RNA, 34 nt, synthetic construct
  source 1..34: mol_type = other RNA
ttgaaacgacttctcttgtgagaagtcgtttcaa

SEQ ID NO: 731 - RNA, 34 nt, synthetic construct
  source 1..34: mol_type = other RNA
taacttgtggtcttcataagaagaccacaagtta

SEQ ID NO: 732 - RNA, 34 nt, synthetic construct
  source 1..34: mol_type = other RNA
tccaggtagatgttcatgggaacatctacctgga

SEQ ID NO: 733 - RNA, 34 nt, synthetic construct
  source 1..34: mol_type = other RNA
tctgtgttctggcacctgcgtgccagaacacaga

SEQ ID NO: 734 - RNA, 34 nt, synthetic construct
  source 1..34: mol_type = other RNA
taacttgccaccttctcaagaaggtggcaagtta

SEQ ID NO: 735 - RNA, 34 nt, synthetic construct
  source 1..34: mol_type = other RNA
tgccatggttgcttgtggtcaagcaaccatggca

SEQ ID NO: 736 - RNA, 34 nt, synthetic construct
  source 1..34: mol_type = other RNA
tgacaaatgggcctgatagcaggcccatttgtca

SEQ ID NO: 737 - RNA, 34 nt, synthetic construct
  source 1..34: mol_type = other RNA
taagttgactagacacttttgtctagtcaactta

SEQ ID NO: 738 - RNA, 34 nt, synthetic construct
  source 1..34: mol_type = other RNA
tcatggcgggtgcggttccccgcacccgccatga

SEQ ID NO: 739 - RNA, 34 nt, synthetic construct
  source 1..34: mol_type = other RNA
tccggatctcatcaatgacttgatgagatccgga

SEQ ID NO: 740 - RNA, 34 nt, synthetic construct
  source 1..34: mol_type = other RNA
tgaggaagcctcaaagctctttgaggcttcctca

SEQ ID NO: 741 - RNA, 34 nt, synthetic construct
  source 1..34: mol_type = other RNA
tactttgaacacatgttgccatgtgttcaaagta

SEQ ID NO: 742 - RNA, 34 nt, synthetic construct
  source 1..34: mol_type = other RNA
tctcctcctcagacacaaatgtctgaggaggaga

SEQ ID NO: 743 - RNA, 34 nt, synthetic construct
  source 1..34: mol_type = other RNA
taggaaggctccgtcccgcgacggagccttccta

SEQ ID NO: 744 - RNA, 34 nt, synthetic construct
  source 1..34: mol_type = other RNA
tcgccagaatcacctctgcaggtgattctggcga

SEQ ID NO: 745 - RNA, 34 nt, synthetic construct
  source 1..34: mol_type = other RNA
tggaaagagatctcatcactgagatctctttcca

SEQ ID NO: 746 - RNA, 34 nt, synthetic construct
  source 1..34: mol_type = other RNA
taagtcccggatctcatcagagatccgggactta

SEQ ID NO: 747 - RNA, 34 nt, synthetic construct
  source 1..34: mol_type = other RNA
tgagcttgatcagggcaacccctgatcaagctca

SEQ ID NO: 748 - RNA, 34 nt, synthetic construct
  source 1..34: mol_type = other RNA
tgttgctcattgtctttctagacaatgagcaaca

SEQ ID NO: 749 - RNA, 34 nt, synthetic construct
  source 1..34: mol_type = other RNA
ttgcttgtggtaatcggtagattaccacaagcaa

SEQ ID NO: 750 - RNA, 34 nt, synthetic construct
  source 1..34: mol_type = other RNA
ttcatcactcacattgtagaatgtgagtgatgaa

SEQ ID NO: 751 - RNA, 34 nt, synthetic construct
  source 1..34: mol_type = other RNA
tcagtgtccaagctgaaaccagcttggacactga

SEQ ID NO: 752 - RNA, 34 nt, synthetic construct
  source 1..34: mol_type = other RNA
tccattcttgatgtagacctacatcaagaatgga

SEQ ID NO: 753 - RNA, 34 nt, synthetic construct
  source 1..34: mol_type = other RNA
taacaatgtgctgctgtcaagcagcacattgtta

SEQ ID NO: 754 - RNA, 34 nt, synthetic construct
  source 1..34: mol_type = other RNA
tgacttcaacttgtggtctcacaagttgaagtca

SEQ ID NO: 755 - RNA, 33 nt, synthetic construct
  source 1..33: mol_type = other RNA
ttgccacagagactcagagagtctctgtggcaa

SEQ ID NO: 756 - RNA, 30 nt, synthetic construct
  source 1..30: mol_type = other RNA
ttgaatgaaacgacttctcgtttcattcaa

SEQ ID NO: 757 - RNA, 34 nt, synthetic construct; identical to SEQ ID NO: 505
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylguanosine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methylcytidine
  modified_base 9: mod_base = OTHER; note = 2'-O-methylcytidine
  modified_base 10: mod_base = OTHER; note = 2'-O-methylcytidine
  modified_base 11: mod_base = OTHER; note = 2'-O-methyladenosine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methylcytidine
  modified_base 16: mod_base = OTHER; note = 2'-O-methylcytidine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methyladenosine
  modified_base 20: mod_base = OTHER; note = 2'-O-methylguanosine
  modified_base 21: mod_base = OTHER; note = 2'-O-methyladenosine
  modified_base 22: mod_base = OTHER; note = 2'-fluorouridine
  modified_base 23: mod_base = OTHER; note = 2'-fluorouridine
  modified_base 24: mod_base = OTHER; note = 2'-fluorouridine
  modified_base 25: mod_base = OTHER; note = 2'-O-methylguanosine
  modified_base 26: mod_base = OTHER; note = 2'-O-methylguanosine
  modified_base 27: mod_base = OTHER; note = 2'-O-methylguanosine
  modified_base 28: mod_base = OTHER; note = 2'-O-methyluridine
  modified_base 29: mod_base = OTHER; note = 2'-O-methyluridine
  modified_base 30: mod_base = OTHER; note = 2'-O-methyluridine
  modified_base 31: mod_base = OTHER; note = 2'-O-methyluridine
  modified_base 32: mod_base = OTHER; note = 2'-O-methylcytidine
  modified_base 33: mod_base = OTHER; note = 2'-O-methyluridine
  modified_base 34: mod_base = OTHER; note = 2'-O-methyladenosine

SEQ ID NO: 758 - RNA, 34 nt, synthetic construct; identical to SEQ ID NO: 506
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyluridine
  modified_base 4: mod_base = OTHER; note = 2'-O-methylguanosine
  modified_base 5: mod_base = OTHER; note = 2'-O-methyluridine
  modified_base 6: mod_base = OTHER; note = 2'-O-methylcytidine
  modified_base 7: mod_base = OTHER; note = 2'-O-methyluridine
  modified_base 8: mod_base = OTHER; note = 2'-O-methylguanosine
  modified_base 9: mod_base = OTHER; note = 2'-O-methyladenosine
  modified_base 10: mod_base = OTHER; note = 2'-O-methyluridine
  modified_base 11: mod_base = OTHER; note = 2'-O-methylcytidine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methylcytidine
  modified_base 16: mod_base = OTHER; note = 2'-O-methyluridine
  modified_base 17: mod_base = OTHER; note = 2'-O-methyladenosine
  modified_base 18: mod_base = OTHER; note = 2'-O-methylguanosine
  modified_base 19: mod_base = OTHER; note = 2'-O-methylcytidine
  modified_base 20: mod_base = OTHER; note = 2'-O-methylguanosine
  modified_base 21: mod_base = OTHER; note = 2'-O-methyladenosine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluoroguanosine
  modified_base 25: mod_base = OTHER; note = 2'-O-methyladenosine
  modified_base 26: mod_base = OTHER; note = 2'-O-methyluridine
  modified_base 27: mod_base = OTHER; note = 2'-O-methylcytidine
  modified_base 28: mod_base = OTHER; note = 2'-O-methyladenosine
  modified_base 29: mod_base = OTHER; note = 2'-O-methylguanosine
  modified_base 30: mod_base = OTHER; note = 2'-O-methyladenosine
  modified_base 31: mod_base = OTHER; note = 2'-O-methylcytidine
  modified_base 32: mod_base = OTHER; note = 2'-O-methyladenosine
  modified_base 33: mod_base = OTHER; note = 2'-O-methylguanosine
  modified_base 34: mod_base = OTHER; note = 2'-O-methyladenosine

SEQ ID NO: 759 - RNA, 34 nt, synthetic construct; identical to SEQ ID NO: 507
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylcytidine
  modified_base 4: mod_base = OTHER; note = 2'-O-methylcytidine
  modified_base 5: mod_base = OTHER; note = 2'-O-methyladenosine
  modified_base 6: mod_base = OTHER; note = 2'-O-methyluridine
  modified_base 7: mod_base = OTHER; note = 2'-O-methylguanosine
  modified_base 8: mod_base = OTHER; note = 2'-O-methylcytidine
  modified_base 9: mod_base = OTHER; note = 2'-O-methylcytidine
  modified_base 10: mod_base = OTHER; note = 2'-O-methyladenosine
  modified_base 11: mod_base = OTHER; note = 2'-O-methylcytidine
  modified_base 12: mod_base = OTHER; note = 2'-O-methyladenosine
  modified_base 13: mod_base = OTHER; note = 2'-O-methylguanosine
  modified_base 14: mod_base = OTHER; note = 2'-fluoroadenosine
  modified_base 15: mod_base = OTHER; note = 2'-O-methylguanosine
  modified_base 16: mod_base = OTHER; note = 2'-O-methyladenosine
  modified_base 17: mod_base = OTHER; note = 2'-O-methylcytidine
  modified_base 18: mod_base = OTHER; note = 2'-O-methyluridine
  modified_base 19: mod_base = OTHER; note = 2'-O-methylcytidine
  modified_base 20: mod_base = OTHER; note = 2'-O-methylcytidine
  modified_base 21: mod_base = OTHER; note = 2'-O-methyluridine
  modified_base 22: mod_base = OTHER; note = 2'-fluorocytidine
  modified_base 23: mod_base = OTHER; note = 2'-fluorouridine
  modified_base 24: mod_base = OTHER; note = 2'-fluoroguanosine
  modified_base 25: mod_base = OTHER; note = 2'-O-methyluridine
  modified_base 26: mod_base = OTHER; note = 2'-O-methylguanosine
  modified_base 27: mod_base = OTHER; note = 2'-O-methylguanosine
  modified_base 28: mod_base = OTHER; note = 2'-O-methylcytidine
  modified_base 29: mod_base = OTHER; note = 2'-O-methyladenosine
  modified_base 30: mod_base = OTHER; note = 2'-O-methyluridine
  modified_base 31: mod_base = OTHER; note = 2'-O-methylguanosine
  modified_base 32: mod_base = OTHER; note = 2'-O-methylguanosine
  modified_base 33: mod_base = OTHER; note = 2'-O-methyluridine
  modified_base 34: mod_base = OTHER; note = 2'-O-methyladenosine

SEQ ID NO: 760 - RNA, 34 nt, synthetic construct; identical to SEQ ID NO: 508
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyluridine
  modified_base 4: mod_base = OTHER; note = 2'-O-methylcytidine
  modified_base 5: mod_base = OTHER; note = 2'-O-methylcytidine
  modified_base 6: mod_base = OTHER; note = 2'-O-methyladenosine
  modified_base 7: mod_base = OTHER; note = 2'-O-methyluridine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methyladenosine
  modified_base 11: mod_base = OTHER; note = 2'-O-methylguanosine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methylcytidine
  modified_base 16: mod_base = OTHER; note = 2'-O-methyladenosine
  modified_base 17: mod_base = OTHER; note = 2'-O-methylguanosine
  modified_base 18: mod_base = OTHER; note = 2'-O-methylguanosine
  modified_base 19: mod_base = OTHER; note = 2'-O-methyluridine
  modified_base 20: mod_base = OTHER; note = 2'-O-methylguanosine
  modified_base 21: mod_base = OTHER; note = 2'-O-methylguanosine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluorocytidine
  modified_base 25: mod_base = OTHER; note = 2'-O-methyluridine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methyladenosine
  modified_base 29: mod_base = OTHER; note = 2'-O-methyluridine
  modified_base 30: mod_base = OTHER; note = 2'-O-methylguanosine
  modified_base 31: mod_base = OTHER; note = 2'-O-methylguanosine
  modified_base 32: mod_base = OTHER; note = 2'-O-methyladenosine
  modified_base 33: mod_base = OTHER; note = 2'-O-methyluridine
  modified_base 34: mod_base = OTHER; note = 2'-O-methyladenosine

SEQ ID NO: 761 - RNA, 34 nt, synthetic construct; identical to SEQ ID NO: 509
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methylcytidine
  modified_base 6: mod_base = OTHER; note = 2'-O-methylcytidine
  modified_base 7: mod_base = OTHER; note = 2'-O-methylcytidine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = OTHER; note = 2'-O-methyluridine
  modified_base 12: mod_base = OTHER; note = 2'-O-methylcytidine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methylcytidine
  modified_base 16: mod_base = OTHER; note = 2'-O-methyladenosine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methyluridine
  modified_base 20: mod_base = OTHER; note = 2'-O-methylguanosine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluoroguanosine
  modified_base 24: mod_base = OTHER; note = 2'-fluoroadenosine
  modified_base 25: mod_base = OTHER; note = 2'-O-methyluridine
  modified_base 26: mod_base = OTHER; note = 2'-O-methyluridine
  modified_base 27: mod_base = OTHER; note = 2'-O-methyluridine
  modified_base 28: mod_base = OTHER; note = 2'-O-methylguanosine
  modified_base 29: mod_base = OTHER; note = 2'-O-methylguanosine
  modified_base 30: mod_base = OTHER; note = 2'-O-methylguanosine
  modified_base 31: mod_base = OTHER; note = 2'-O-methyluridine
  modified_base 32: mod_base = OTHER; note = 2'-O-methyluridine
  modified_base 33: mod_base = OTHER; note = 2'-O-methyluridine
  modified_base 34: mod_base = OTHER; note = 2'-O-methyladenosine

SEQ ID NO: 762 - RNA, 34 nt, synthetic construct; identical to SEQ ID NO: 510
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methylcytidine
  modified_base 4: mod_base = OTHER; note = 2'-O-methyladenosine
  modified_base 5: mod_base = OTHER; note = 2'-O-methyluridine
  modified_base 6: mod_base = OTHER; note = 2'-O-methylcytidine
  modified_base 7: mod_base = OTHER; note = 2'-O-methyluridine
  modified_base 8: mod_base = OTHER; note = 2'-O-methyladenosine
  modified_base 9: mod_base = OTHER; note = 2'-O-methylguanosine
  modified_base 10: mod_base = OTHER; note = 2'-O-methylcytidine
  modified_base 11: mod_base = OTHER; note = 2'-O-methyladenosine
  modified_base 12: mod_base = OTHER; note = 2'-O-methylcytidine
  modified_base 13: mod_base = OTHER; note = 2'-O-methylcytidine
  modified_base 14: mod_base = OTHER; note = 2'-fluoroadenosine
  modified_base 15: mod_base = OTHER; note = 2'-O-methylguanosine
  modified_base 16: mod_base = OTHER; note = 2'-O-methylguanosine
  modified_base 17: mod_base = OTHER; note = 2'-O-methyluridine
  modified_base 18: mod_base = OTHER; note = 2'-O-methyladenosine
  modified_base 19: mod_base = OTHER; note = 2'-O-methylguanosine
  modified_base 20: mod_base = OTHER; note = 2'-O-methylcytidine
  modified_base 21: mod_base = OTHER; note = 2'-O-methyluridine
  modified_base 22: mod_base = OTHER; note = 2'-fluoroguanosine
  modified_base 23: mod_base = OTHER; note = 2'-fluoroguanosine
  modified_base 24: mod_base = OTHER; note = 2'-fluorouridine
  modified_base 25: mod_base = OTHER; note = 2'-O-methylguanosine
  modified_base 26: mod_base = OTHER; note = 2'-O-methylcytidine
  modified_base 27: mod_base = OTHER; note = 2'-O-methyluridine
  modified_base 28: mod_base = OTHER; note = 2'-O-methyladenosine
  modified_base 29: mod_base = OTHER; note = 2'-O-methylguanosine
  modified_base 30: mod_base = OTHER; note = 2'-O-methyladenosine
  modified_base 31: mod_base = OTHER; note = 2'-O-methyluridine
  modified_base 32: mod_base = OTHER; note = 2'-O-methylguanosine
  modified_base 33: mod_base = OTHER; note = 2'-O-methylguanosine
  modified_base 34: mod_base = OTHER; note = 2'-O-methyladenosine

SEQ ID NO: 763 - RNA, 34 nt, synthetic construct; identical to SEQ ID NO: 511
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methylcytidine
  modified_base 7: mod_base = OTHER; note = 2'-O-methylcytidine
  modified_base 8: mod_base = OTHER; note = 2'-O-methylcytidine
  modified_base 9: mod_base = OTHER; note = 2'-O-methyladenosine
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-O-methyluridine
  modified_base 13: mod_base = OTHER; note = 2'-O-methylcytidine
  modified_base 14: mod_base = OTHER; note = 2'-fluorocytidine
  modified_base 15: mod_base = OTHER; note = 2'-O-methyluridine
  modified_base 16: mod_base = OTHER; note = 2'-O-methylcytidine
  modified_base 17: mod_base = OTHER; note = 2'-O-methyladenosine
  modified_base 18: mod_base = OTHER; note = 2'-O-methyluridine
  modified_base 19: mod_base = OTHER; note = 2'-O-methylcytidine
  modified_base 20: mod_base = OTHER; note = 2'-O-methyladenosine
  modified_base 21: mod_base = OTHER; note = 2'-O-methylguanosine
  modified_base 22: mod_base = OTHER; note = 2'-fluoroguanosine
  modified_base 23: mod_base = OTHER; note = 2'-fluoroadenosine
  modified_base 24: mod_base = OTHER; note = 2'-fluorouridine
  modified_base 25: mod_base = OTHER; note = 2'-O-methyluridine
  modified_base 26: mod_base = OTHER; note = 2'-O-methyluridine
  modified_base 27: mod_base = OTHER; note = 2'-O-methylguanosine
  modified_base 28: mod_base = OTHER; note = 2'-O-methylguanosine
  modified_base 29: mod_base = OTHER; note = 2'-O-methylguanosine
  modified_base 30: mod_base = OTHER; note = 2'-O-methyluridine
  modified_base 31: mod_base = OTHER; note = 2'-O-methyluridine
  modified_base 32: mod_base = OTHER; note = 2'-O-methyluridine
  modified_base 33: mod_base = OTHER; note = 2'-O-methyluridine
  modified_base 34: mod_base = OTHER; note = 2'-O-methyladenosine

SEQ ID NO: 764 - RNA, 34 nt, synthetic construct; identical to SEQ ID NO: 512
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methyluridine
  modified_base 4: mod_base = OTHER; note = 2'-O-methylcytidine
  modified_base 5: mod_base = OTHER; note = 2'-O-methyluridine
  modified_base 6: mod_base = OTHER; note = 2'-O-methylguanosine
  modified_base 7: mod_base = OTHER; note = 2'-O-methyladenosine
  modified_base 8: mod_base = OTHER; note = 2'-O-methyluridine
  modified_base 9: mod_base = OTHER; note = 2'-O-methylcytidine
  modified_base 10: mod_base = OTHER; note = 2'-O-methylcytidine
  modified_base 11: mod_base = OTHER; note = 2'-O-methyladenosine
  modified_base 12: mod_base = OTHER; note = 2'-O-methyluridine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-O-methylguanosine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methylcytidine
  modified_base 20: mod_base = OTHER; note = 2'-O-methyluridine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluoroadenosine
  modified_base 24: mod_base = OTHER; note = 2'-fluorouridine
  modified_base 25: mod_base = OTHER; note = 2'-O-methylguanosine
  modified_base 26: mod_base = OTHER; note = 2'-O-methylguanosine
  modified_base 27: mod_base = OTHER; note = 2'-O-methyladenosine
  modified_base 28: mod_base = OTHER; note = 2'-O-methyluridine
  modified_base 29: mod_base = OTHER; note = 2'-O-methylcytidine
  modified_base 30: mod_base = OTHER; note = 2'-O-methyladenosine
  modified_base 31: mod_base = OTHER; note = 2'-O-methylguanosine
  modified_base 32: mod_base = OTHER; note = 2'-O-methyladenosine
  modified_base 33: mod_base = OTHER; note = 2'-O-methylcytidine
  modified_base 34: mod_base = OTHER; note = 2'-O-methyladenosine

SEQ ID NO: 765 - RNA, 34 nt, synthetic construct; identical to SEQ ID NO: 513
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylcytidine
  modified_base 4: mod_base = OTHER; note = 2'-O-methylcytidine
  modified_base 5: mod_base = OTHER; note = 2'-O-methylcytidine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-O-methyluridine
  modified_base 10: mod_base = OTHER; note = 2'-O-methylcytidine
  modified_base 11: mod_base = OTHER; note = 2'-O-methylcytidine
  modified_base 12: mod_base = OTHER; note = 2'-O-methyluridine
  modified_base 13: mod_base = OTHER; note = 2'-O-methylcytidine
  modified_base 14: mod_base = OTHER; note = 2'-fluoroadenosine
  modified_base 15: mod_base = OTHER; note = 2'-O-methyluridine
  modified_base 16: mod_base = OTHER; note = 2'-O-methylcytidine
  modified_base 17: mod_base = OTHER; note = 2'-O-methyluridine
  modified_base 18: mod_base = OTHER; note = 2'-O-methyluridine
  modified_base 19: mod_base = OTHER; note = 2'-O-methylguanosine
  modified_base 20: mod_base = OTHER; note = 2'-O-methyladenosine
  modified_base 21: mod_base = OTHER; note = 2'-O-methyluridine
  modified_base 22: mod_base = OTHER; note = 2'-fluoroguanosine
  modified_base 23: mod_base = OTHER; note = 2'-fluoroadenosine
  modified_base 24: mod_base = OTHER; note = 2'-fluoroguanosine
  modified_base 25: mod_base = OTHER; note = 2'-O-methylguanosine
  modified_base 26: mod_base = OTHER; note = 2'-O-methyladenosine
  modified_base 27: mod_base = OTHER; note = 2'-O-methyluridine
  modified_base 28: mod_base = OTHER; note = 2'-O-methyluridine
  modified_base 29: mod_base = OTHER; note = 2'-O-methyluridine
  modified_base 30: mod_base = OTHER; note = 2'-O-methylguanosine
  modified_base 31: mod_base = OTHER; note = 2'-O-methylguanosine
  modified_base 32: mod_base = OTHER; note = 2'-O-methylguanosine
  modified_base 33: mod_base = OTHER; note = 2'-O-methyluridine
  modified_base 34: mod_base = OTHER; note = 2'-O-methyladenosine

SEQ ID NO: 766 - RNA, 34 nt, synthetic construct; identical to SEQ ID NO: 514
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylcytidine
  modified_base 4: mod_base = OTHER; note = 2'-O-methylcytidine
  modified_base 5: mod_base = OTHER; note = 2'-O-methyladenosine
  modified_base 6: mod_base = OTHER; note = 2'-O-methyluridine
  modified_base 7: mod_base = OTHER; note = 2'-O-methylcytidine
  modified_base 8: mod_base = OTHER; note = 2'-O-methyluridine
  modified_base 9: mod_base = OTHER; note = 2'-O-methyladenosine
  modified_base 10: mod_base = OTHER; note = 2'-O-methylguanosine
  modified_base 11: mod_base = OTHER; note = 2'-O-methylcytidine
  modified_base 12: mod_base = OTHER; note = 2'-O-methyladenosine
  modified_base 13: mod_base = OTHER; note = 2'-O-methylcytidine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-O-methylguanosine
  modified_base 17: mod_base = OTHER; note = 2'-O-methylguanosine
  modified_base 18: mod_base = OTHER; note = 2'-O-methyluridine
  modified_base 19: mod_base = OTHER; note = 2'-O-methyladenosine
  modified_base 20: mod_base = OTHER; note = 2'-O-methyluridine
  modified_base 21: mod_base = OTHER; note = 2'-O-methylguanosine
  modified_base 22: mod_base = OTHER; note = 2'-fluoroguanosine
  modified_base 23: mod_base = OTHER; note = 2'-fluorouridine
  modified_base 24: mod_base = OTHER; note = 2'-fluoroguanosine
  modified_base 25: mod_base = OTHER; note = 2'-O-methylcytidine
  modified_base 26: mod_base = OTHER; note = 2'-O-methyluridine
  modified_base 27: mod_base = OTHER; note = 2'-O-methyladenosine
  modified_base 28: mod_base = OTHER; note = 2'-O-methylguanosine
  modified_base 29: mod_base = OTHER; note = 2'-O-methyladenosine
  modified_base 30: mod_base = OTHER; note = 2'-O-methyluridine
  modified_base 31: mod_base = OTHER; note = 2'-O-methylguanosine
  modified_base 32: mod_base = OTHER; note = 2'-O-methylguanosine
  modified_base 33: mod_base = OTHER; note = 2'-O-methyladenosine
  modified_base 34: mod_base = OTHER; note = 2'-O-methyladenosine

SEQ ID NO: 767 - RNA, 34 nt, synthetic construct; identical to SEQ ID NO: 515
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-O-methylcytidine
  modified_base 5: mod_base = OTHER; note = 2'-O-methylcytidine
  modified_base 6: mod_base = OTHER; note = 2'-O-methylcytidine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyluridine
  modified_base 11: mod_base = OTHER; note = 2'-O-methylcytidine
  modified_base 12: mod_base = OTHER; note = 2'-O-methylcytidine
  modified_base 13: mod_base = OTHER; note = 2'-O-methyluridine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methyluridine
  modified_base 19: mod_base = OTHER; note = 2'-O-methyluridine
  modified_base 20: mod_base = OTHER; note = 2'-O-methyluridine
  modified_base 21: mod_base = OTHER; note = 2'-O-methylguanosine
  modified_base 22: mod_base = OTHER; note = 2'-fluoroadenosine
  modified_base 23: mod_base = OTHER; note = 2'-fluoroguanosine
  modified_base 24: mod_base = OTHER; note = 2'-fluoroguanosine
  modified_base 25: mod_base = OTHER; note = 2'-O-methyladenosine
  modified_base 26: mod_base = OTHER; note = 2'-O-methyluridine
  modified_base 27: mod_base = OTHER; note = 2'-O-methyluridine
  modified_base 28: mod_base = OTHER; note = 2'-O-methyluridine
  modified_base 29: mod_base = OTHER; note = 2'-O-methylguanosine
  modified_base 30: mod_base = OTHER; note = 2'-O-methylguanosine
  modified_base 31: mod_base = OTHER; note = 2'-O-methylguanosine
  modified_base 32: mod_base = OTHER; note = 2'-O-methyluridine
  modified_base 33: mod_base = OTHER; note = 2'-O-methyluridine
  modified_base 34: mod_base = OTHER; note = 2'-O-methyladenosine

SEQ ID NO: 768 - RNA, 34 nt, synthetic construct; identical to SEQ ID NO: 516
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methyluridine
  modified_base 5: mod_base = OTHER; note = 2'-O-methylguanosine
  modified_base 6: mod_base = OTHER; note = 2'-O-methylcytidine
  modified_base 7: mod_base = OTHER; note = 2'-O-methylcytidine
  modified_base 8: mod_base = OTHER; note = 2'-O-methyladenosine
  modified_base 9: mod_base = OTHER; note = 2'-O-methylcytidine
  modified_base 10: mod_base = OTHER; note = 2'-O-methyladenosine
  modified_base 11: mod_base = OTHER; note = 2'-O-methylguanosine
  modified_base 12: mod_base = OTHER; note = 2'-O-methyladenosine
  modified_base 13: mod_base = OTHER; note = 2'-O-methylguanosine
  modified_base 14: mod_base = OTHER; note = 2'-fluoroadenosine
  modified_base 15: mod_base = OTHER; note = 2'-O-methylcytidine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methylguanosine
  modified_base 20: mod_base = OTHER; note = 2'-O-methylguanosine
  modified_base 21: mod_base = OTHER; note = 2'-O-methyluridine
  modified_base 22: mod_base = OTHER; note = 2'-fluorocytidine
  modified_base 23: mod_base = OTHER; note = 2'-fluorouridine
  modified_base 24: mod_base = OTHER; note = 2'-fluorocytidine
  modified_base 25: mod_base = OTHER; note = 2'-O-methyluridine
  modified_base 26: mod_base = OTHER; note = 2'-O-methylguanosine
  modified_base 27: mod_base = OTHER; note = 2'-O-methyluridine
  modified_base 28: mod_base = OTHER; note = 2'-O-methylguanosine
  modified_base 29: mod_base = OTHER; note = 2'-O-methylguanosine
  modified_base 30: mod_base = OTHER; note = 2'-O-methylcytidine
  modified_base 31: mod_base = OTHER; note = 2'-O-methyladenosine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 769 - RNA, 34 nt, synthetic construct; identical to SEQ ID NO: 517
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylguanosine
  modified_base 4: mod_base = OTHER; note = 2'-O-methylcytidine
  modified_base 5: mod_base = OTHER; note = 2'-O-methylcytidine
  modified_base 6: mod_base = OTHER; note = 2'-O-methyladenosine
  modified_base 7: mod_base = OTHER; note = 2'-O-methylcytidine
  modified_base 8: mod_base = OTHER; note = 2'-O-methyladenosine
  modified_base 9: mod_base = OTHER; note = 2'-O-methylguanosine
  modified_base 10: mod_base = OTHER; note = 2'-O-methyladenosine
  modified_base 11: mod_base = OTHER; note = 2'-O-methylguanosine
  modified_base 12: mod_base = OTHER; note = 2'-O-methyladenosine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methylcytidine
  modified_base 16: mod_base = OTHER; note = 2'-O-methyladenosine
  modified_base 17: mod_base = OTHER; note = 2'-O-methylguanosine
  modified_base 18: mod_base = OTHER; note = 2'-O-methyladenosine
  modified_base 19: mod_base = OTHER; note = 2'-O-methylguanosine
  modified_base 20: mod_base = OTHER; note = 2'-O-methylguanosine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluorouridine
  modified_base 24: mod_base = OTHER; note = 2'-fluorocytidine
  modified_base 25: mod_base = OTHER; note = 2'-O-methyluridine
  modified_base 26: mod_base = OTHER; note = 2'-O-methylcytidine
  modified_base 27: mod_base = OTHER; note = 2'-O-methyluridine
  modified_base 28: mod_base = OTHER; note = 2'-O-methylguanosine
  modified_base 29: mod_base = OTHER; note = 2'-O-methyluridine
  modified_base 30: mod_base = OTHER; note = 2'-O-methylguanosine
  modified_base 31: mod_base = OTHER; note = 2'-O-methylguanosine
  modified_base 32: mod_base = OTHER; note = 2'-O-methylcytidine
  modified_base 33: mod_base = OTHER; note = 2'-O-methyladenosine
  modified_base 34: mod_base = OTHER; note = 2'-O-methyladenosine

SEQ ID NO: 770 - RNA, 34 nt, synthetic construct; identical to SEQ ID NO: 518
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyluridine
  modified_base 4: mod_base = OTHER; note = 2'-O-methylguanosine
  modified_base 5: mod_base = OTHER; note = 2'-O-methyladenosine
  modified_base 6: mod_base = OTHER; note = 2'-O-methyluridine
  modified_base 7: mod_base = OTHER; note = 2'-O-methylguanosine
  modified_base 8: mod_base = OTHER; note = 2'-O-methyladenosine
  modified_base 9: mod_base = OTHER; note = 2'-O-methylcytidine
  modified_base 10: mod_base = OTHER; note = 2'-O-methyladenosine
  modified_base 11: mod_base = OTHER; note = 2'-O-methyluridine
  modified_base 12: mod_base = OTHER; note = 2'-O-methylguanosine
  modified_base 13: mod_base = OTHER; note = 2'-O-methylguanosine
  modified_base 14: mod_base = OTHER; note = 2'-fluorocytidine
  modified_base 15: mod_base = OTHER; note = 2'-O-methylguanosine
  modified_base 16: mod_base = OTHER; note = 2'-O-methylguanosine
  modified_base 17: mod_base = OTHER; note = 2'-O-methylguanosine
  modified_base 18: mod_base = OTHER; note = 2'-O-methyluridine
  modified_base 19: mod_base = OTHER; note = 2'-O-methylguanosine
  modified_base 20: mod_base = OTHER; note = 2'-O-methylcytidine
  modified_base 21: mod_base = OTHER; note = 2'-O-methylguanosine
  modified_base 22: mod_base = OTHER; note = 2'-fluorocytidine
  modified_base 23: mod_base = OTHER; note = 2'-fluorocytidine
  modified_base 24: mod_base = OTHER; note = 2'-fluoroadenosine
  modified_base 25: mod_base = OTHER; note = 2'-O-methyluridine
  modified_base 26: mod_base = OTHER; note = 2'-O-methylguanosine
  modified_base 27: mod_base = OTHER; note = 2'-O-methyluridine
  modified_base 28: mod_base = OTHER; note = 2'-O-methylcytidine
  modified_base 29: mod_base = OTHER; note = 2'-O-methyladenosine
  modified_base 30: mod_base = OTHER; note = 2'-O-methyluridine
  modified_base 31: mod_base = OTHER; note = 2'-O-methylcytidine
  modified_base 32: mod_base = OTHER; note = 2'-O-methyladenosine
  modified_base 33: mod_base = OTHER; note = 2'-O-methyluridine
  modified_base 34: mod_base = OTHER; note = 2'-O-methyladenosine

SEQ ID NO: 771 - RNA, 34 nt, synthetic construct; identical to SEQ ID NO: 519
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylcytidine
  modified_base 4: mod_base = OTHER; note = 2'-O-methylcytidine
  modified_base 5: mod_base = OTHER; note = 2'-O-methyladenosine
  modified_base 6: mod_base = OTHER; note = 2'-O-methyluridine
  modified_base 7: mod_base = OTHER; note = 2'-O-methyladenosine
  modified_base 8: mod_base = OTHER; note = 2'-O-methyluridine
  modified_base 9: mod_base = OTHER; note = 2'-O-methylcytidine
  modified_base 10: mod_base = OTHER; note = 2'-O-methylcytidine
  modified_base 11: mod_base = OTHER; note = 2'-O-methyluridine
  modified_base 12: mod_base = OTHER; note = 2'-O-methyluridine
  modified_base 13: mod_base = OTHER; note = 2'-O-methylguanosine
  modified_base 14: mod_base = OTHER; note = 2'-fluoroadenosine
  modified_base 15: mod_base = OTHER; note = 2'-O-methylcytidine
  modified_base 16: mod_base = OTHER; note = 2'-O-methyluridine
  modified_base 17: mod_base = OTHER; note = 2'-O-methyluridine
  modified_base 18: mod_base = OTHER; note = 2'-O-methyluridine
  modified_base 19: mod_base = OTHER; note = 2'-O-methylguanosine
  modified_base 20: mod_base = OTHER; note = 2'-O-methylguanosine
  modified_base 21: mod_base = OTHER; note = 2'-O-methyluridine
  modified_base 22: mod_base = OTHER; note = 2'-fluorocytidine
  modified_base 23: mod_base = OTHER; note = 2'-fluoroadenosine
  modified_base 24: mod_base = OTHER; note = 2'-fluoroadenosine
  modified_base 25: mod_base = OTHER; note = 2'-O-methylguanosine
  modified_base 26: mod_base = OTHER; note = 2'-O-methylguanosine
  modified_base 27: mod_base = OTHER; note = 2'-O-methyladenosine
  modified_base 28: mod_base = OTHER; note = 2'-O-methyluridine
  modified_base 29: mod_base = OTHER; note = 2'-O-methyladenosine
  modified_base 30: mod_base = OTHER; note = 2'-O-methyluridine
  modified_base 31: mod_base = OTHER; note = 2'-O-methylguanosine
  modified_base 32: mod_base = OTHER; note = 2'-O-methylguanosine
  modified_base 33: mod_base = OTHER; note = 2'-O-methyladenosine
  modified_base 34: mod_base = OTHER; note = 2'-O-methyladenosine

SEQ ID NO: 772 - RNA, 34 nt, synthetic construct; identical to SEQ ID NO: 520
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylcytidine
  modified_base 4: mod_base = OTHER; note = 2'-O-methyladenosine
  modified_base 5: mod_base = OTHER; note = 2'-O-methylcytidine
  modified_base 6: mod_base = OTHER; note = 2'-O-methylcytidine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-O-methylcytidine
  modified_base 10: mod_base = OTHER; note = 2'-O-methyluridine
  modified_base 11: mod_base = OTHER; note = 2'-O-methyluridine
  modified_base 12: mod_base = OTHER; note = 2'-O-methylguanosine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyluridine
  modified_base 16: mod_base = OTHER; note = 2'-O-methylguanosine
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyluridine
  modified_base 22: mod_base = OTHER; note = 2'-fluorouridine
  modified_base 23: mod_base = OTHER; note = 2'-fluorocytidine
  modified_base 24: mod_base = OTHER; note = 2'-fluoroadenosine
  modified_base 25: mod_base = OTHER; note = 2'-O-methyladenosine
  modified_base 26: mod_base = OTHER; note = 2'-O-methylguanosine
  modified_base 27: mod_base = OTHER; note = 2'-O-methyluridine
  modified_base 28: mod_base = OTHER; note = 2'-O-methyluridine
  modified_base 29: mod_base = OTHER; note = 2'-O-methylguanosine
  modified_base 30: mod_base = OTHER; note = 2'-O-methylguanosine
  modified_base 31: mod_base = OTHER; note = 2'-O-methyluridine
  modified_base 32: mod_base = OTHER; note = 2'-O-methylguanosine
  modified_base 33: mod_base = OTHER; note = 2'-O-methyluridine
  modified_base 34: mod_base = OTHER; note = 2'-O-methyladenosine

SEQ ID NO: 773 - RNA, 34 nt, synthetic construct; identical to SEQ ID NO: 521
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methylcytidine
  modified_base 4: mod_base = OTHER; note = 2'-O-methylcytidine
  modified_base 5: mod_base = OTHER; note = 2'-O-methyladenosine
  modified_base 6: mod_base = OTHER; note = 2'-O-methylcytidine
  modified_base 7: mod_base = OTHER; note = 2'-O-methyladenosine
  modified_base 8: mod_base = OTHER; note = 2'-O-methylguanosine
  modified_base 9: mod_base = OTHER; note = 2'-O-methyladenosine
  modified_base 10: mod_base = OTHER; note = 2'-O-methylguanosine
  modified_base 11: mod_base = OTHER; note = 2'-O-methyladenosine
  modified_base 12: mod_base = OTHER; note = 2'-O-methylcytidine
  modified_base 13: mod_base = OTHER; note = 2'-O-methyluridine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-O-methylguanosine
  modified_base 17: mod_base = OTHER; note = 2'-O-methyladenosine
  modified_base 18: mod_base = OTHER; note = 2'-O-methylguanosine
  modified_base 19: mod_base = OTHER; note = 2'-O-methyladenosine
  modified_base 20: mod_base = OTHER; note = 2'-O-methyluridine
  modified_base 21: mod_base = OTHER; note = 2'-O-methylguanosine
  modified_base 22: mod_base = OTHER; note = 2'-fluoroadenosine
  modified_base 23: mod_base = OTHER; note = 2'-fluoroguanosine
  modified_base 24: mod_base = OTHER; note = 2'-fluorouridine
  modified_base 25: mod_base = OTHER; note = 2'-O-methylcytidine
  modified_base 26: mod_base = OTHER; note = 2'-O-methyluridine
  modified_base 27: mod_base = OTHER; note = 2'-O-methylcytidine
  modified_base 28: mod_base = OTHER; note = 2'-O-methyluridine
  modified_base 29: mod_base = OTHER; note = 2'-O-methylguanosine
  modified_base 30: mod_base = OTHER; note = 2'-O-methyluridine
  modified_base 31: mod_base = OTHER; note = 2'-O-methylguanosine
  modified_base 32: mod_base = OTHER; note = 2'-O-methylguanosine
  modified_base 33: mod_base = OTHER; note = 2'-O-methylcytidine
  modified_base 34: mod_base = OTHER; note = 2'-O-methyladenosine

SEQ ID NO: 774 - RNA, 34 nt, synthetic construct; identical to SEQ ID NO: 522
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methylcytidine
  modified_base 4: mod_base = OTHER; note = 2'-O-methyladenosine
  modified_base 5: mod_base = OTHER; note = 2'-O-methyluridine
  modified_base 6: mod_base = OTHER; note = 2'-O-methylguanosine
  modified_base 7: mod_base = OTHER; note = 2'-O-methylcytidine
  modified_base 8: mod_base = OTHER; note = 2'-O-methylcytidine
  modified_base 9: mod_base = OTHER; note = 2'-O-methyladenosine
  modified_base 10: mod_base = OTHER; note = 2'-O-methylcytidine
  modified_base 11: mod_base = OTHER; note = 2'-O-methyladenosine
  modified_base 12: mod_base = OTHER; note = 2'-O-methylguanosine
  modified_base 13: mod_base = OTHER; note = 2'-O-methyladenosine
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-O-methylcytidine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methyladenosine
  modified_base 20: mod_base = OTHER; note = 2'-O-methyluridine
  modified_base 21: mod_base = OTHER; note = 2'-O-methylcytidine
  modified_base 22: mod_base = OTHER; note = 2'-fluorouridine
  modified_base 23: mod_base = OTHER; note = 2'-fluorocytidine
  modified_base 24: mod_base = OTHER; note = 2'-fluorouridine
  modified_base 25: mod_base = OTHER; note = 2'-O-methylguanosine
  modified_base 26: mod_base = OTHER; note = 2'-O-methyluridine
  modified_base 27: mod_base = OTHER; note = 2'-O-methylguanosine
  modified_base 28: mod_base = OTHER; note = 2'-O-methylguanosine
  modified_base 29: mod_base = OTHER; note = 2'-O-methylcytidine
  modified_base 30: mod_base = OTHER; note = 2'-O-methyladenosine
  modified_base 31: mod_base = OTHER; note = 2'-O-methyluridine
  modified_base 32: mod_base = OTHER; note = 2'-O-methylguanosine
  modified_base 33: mod_base = OTHER; note = 2'-O-methylguanosine
  modified_base 34: mod_base = OTHER; note = 2'-O-methyladenosine

SEQ ID NO: 775 - RNA, 34 nt, synthetic construct; identical to SEQ ID NO: 523
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methyluridine
  modified_base 5: mod_base = OTHER; note = 2'-O-methylcytidine
  modified_base 6: mod_base = OTHER; note = 2'-O-methyluridine
  modified_base 7: mod_base = OTHER; note = 2'-O-methyladenosine
  modified_base 8: mod_base = OTHER; note = 2'-O-methylguanosine
  modified_base 9: mod_base = OTHER; note = 2'-O-methylcytidine
  modified_base 10: mod_base = OTHER; note = 2'-O-methyladenosine
  modified_base 11: mod_base = OTHER; note = 2'-O-methylcytidine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluoroguanosine
  modified_base 15: mod_base = OTHER; note = 2'-O-methylguanosine
  modified_base 16: mod_base = OTHER; note = 2'-O-methyluridine
  modified_base 17: mod_base = OTHER; note = 2'-O-methyladenosine
  modified_base 18: mod_base = OTHER; note = 2'-O-methylguanosine
  modified_base 19: mod_base = OTHER; note = 2'-O-methyladenosine
  modified_base 20: mod_base = OTHER; note = 2'-O-methylcytidine
  modified_base 21: mod_base = OTHER; note = 2'-O-methylcytidine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluoroguanosine
  modified_base 25: mod_base = OTHER; note = 2'-O-methyluridine
  modified_base 26: mod_base = OTHER; note = 2'-O-methylguanosine
  modified_base 27: mod_base = OTHER; note = 2'-O-methylcytidine
  modified_base 28: mod_base = OTHER; note = 2'-O-methyluridine
  modified_base 29: mod_base = OTHER; note = 2'-O-methyladenosine
  modified_base 30: mod_base = OTHER; note = 2'-O-methylguanosine
  modified_base 31: mod_base = OTHER; note = 2'-O-methyladenosine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 776 - RNA, 34 nt, synthetic construct; identical to SEQ ID NO: 524
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methyluridine
  modified_base 4: mod_base = OTHER; note = 2'-O-methylcytidine
  modified_base 5: mod_base = OTHER; note = 2'-O-methylcytidine
  modified_base 6: mod_base = OTHER; note = 2'-O-methyladenosine
  modified_base 7: mod_base = OTHER; note = 2'-O-methyluridine
  modified_base 8: mod_base = OTHER; note = 2'-O-methyladenosine
  modified_base 9: mod_base = OTHER; note = 2'-O-methyluridine
  modified_base 10: mod_base = OTHER; note = 2'-O-methylcytidine
  modified_base 11: mod_base = OTHER; note = 2'-O-methylcytidine
  modified_base 12: mod_base = OTHER; note = 2'-O-methyluridine
  modified_base 13: mod_base = OTHER; note = 2'-O-methyluridine
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-O-methylcytidine
  modified_base 17: mod_base = OTHER; note = 2'-O-methyluridine
  modified_base 18: mod_base = OTHER; note = 2'-O-methyluridine
  modified_base 19: mod_base = OTHER; note = 2'-O-methyluridine
  modified_base 20: mod_base = OTHER; note = 2'-O-methyluridine
  modified_base 21: mod_base = OTHER; note = 2'-O-methylcytidine
  modified_base 22: mod_base = OTHER; note = 2'-fluoroadenosine
  modified_base 23: mod_base = OTHER; note = 2'-fluoroadenosine
  modified_base 24: mod_base = OTHER; note = 2'-fluoroguanosine
  modified_base 25: mod_base = OTHER; note = 2'-O-methylguanosine
  modified_base 26: mod_base = OTHER; note = 2'-O-methyladenosine
  modified_base 27: mod_base = OTHER; note = 2'-O-methyluridine
  modified_base 28: mod_base = OTHER; note = 2'-O-methyladenosine
  modified_base 29: mod_base = OTHER; note = 2'-O-methyluridine
  modified_base 30: mod_base = OTHER; note = 2'-O-methylguanosine
  modified_base 31: mod_base = OTHER; note = 2'-O-methylguanosine
  modified_base 32: mod_base = OTHER; note = 2'-O-methyladenosine
  modified_base 33: mod_base = OTHER; note = 2'-O-methyladenosine
  modified_base 34: mod_base = OTHER; note = 2'-O-methyladenosine

SEQ ID NO: 777 - RNA, 34 nt, synthetic construct; identical to SEQ ID NO: 525
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-O-methyluridine
  modified_base 5: mod_base = OTHER; note = 2'-O-methylcytidine
  modified_base 6: mod_base = OTHER; note = 2'-O-methylcytidine
  modified_base 7: mod_base = OTHER; note = 2'-O-methyladenosine
  modified_base 8: mod_base = OTHER; note = 2'-O-methyluridine
  modified_base 9: mod_base = OTHER; note = 2'-O-methylcytidine
  modified_base 10: mod_base = OTHER; note = 2'-O-methyluridine
  modified_base 11: mod_base = OTHER; note = 2'-O-methyladenosine
  modified_base 12: mod_base = OTHER; note = 2'-O-methylguanosine
  modified_base 13: mod_base = OTHER; note = 2'-O-methylcytidine
  modified_base 14: mod_base = OTHER; note = 2'-fluoroadenosine
  modified_base 15: mod_base = OTHER; note = 2'-O-methylcytidine
  modified_base 16: mod_base = OTHER; note = 2'-O-methylcytidine
  modified_base 17: mod_base = OTHER; note = 2'-O-methyladenosine
  modified_base 18: mod_base = OTHER; note = 2'-O-methylguanosine
  modified_base 19: mod_base = OTHER; note = 2'-O-methylguanosine
  modified_base 20: mod_base = OTHER; note = 2'-O-methylguanosine
  modified_base 21: mod_base = OTHER; note = 2'-O-methyluridine
  modified_base 22: mod_base = OTHER; note = 2'-fluoroguanosine
  modified_base 23: mod_base = OTHER; note = 2'-fluorocytidine
  modified_base 24: mod_base = OTHER; note = 2'-fluorouridine
  modified_base 25: mod_base = OTHER; note = 2'-O-methyladenosine
  modified_base 26: mod_base = OTHER; note = 2'-O-methylguanosine
  modified_base 27: mod_base = OTHER; note = 2'-O-methyladenosine
  modified_base 28: mod_base = OTHER; note = 2'-O-methyluridine
  modified_base 29: mod_base = OTHER; note = 2'-O-methylguanosine
  modified_base 30: mod_base = OTHER; note = 2'-O-methylguanosine
  modified_base 31: mod_base = OTHER; note = 2'-O-methyladenosine
  modified_base 32: mod_base = OTHER; note = 2'-O-methyluridine
  modified_base 33: mod_base = OTHER; note = 2'-O-methylcytidine
  modified_base 34: mod_base = OTHER; note = 2'-O-methyladenosine

SEQ ID NO: 778 - RNA, 34 nt, synthetic construct; identical to SEQ ID NO: 526
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methylcytidine
  modified_base 4: mod_base = OTHER; note = 2'-O-methyladenosine
  modified_base 5: mod_base = OTHER; note = 2'-O-methylcytidine
  modified_base 6: mod_base = OTHER; note = 2'-O-methyladenosine
  modified_base 7: mod_base = OTHER; note = 2'-O-methylguanosine
  modified_base 8: mod_base = OTHER; note = 2'-O-methyladenosine
  modified_base 9: mod_base = OTHER; note = 2'-O-methylguanosine
  modified_base 10: mod_base = OTHER; note = 2'-O-methyladenosine
  modified_base 11: mod_base = OTHER; note = 2'-O-methylcytidine
  modified_base 12: mod_base = OTHER; note = 2'-O-methyluridine
  modified_base 13: mod_base = OTHER; note = 2'-O-methylcytidine
  modified_base 14: mod_base = OTHER; note = 2'-fluoroadenosine
  modified_base 15: mod_base = OTHER; note = 2'-O-methylguanosine
  modified_base 16: mod_base = OTHER; note = 2'-O-methyladenosine
  modified_base 17: mod_base = OTHER; note = 2'-O-methylguanosine
  modified_base 18: mod_base = OTHER; note = 2'-O-methyladenosine
  modified_base 19: mod_base = OTHER; note = 2'-O-methylcytidine
  modified_base 20: mod_base = OTHER; note = 2'-O-methylcytidine
  modified_base 21: mod_base = OTHER; note = 2'-O-methyluridine
  modified_base 22: mod_base = OTHER; note = 2'-fluoroguanosine
  modified_base 23: mod_base = OTHER; note = 2'-fluoroadenosine
  modified_base 24: mod_base = OTHER; note = 2'-fluoroguanosine
  modified_base 25: mod_base = OTHER; note = 2'-O-methyluridine
  modified_base 26: mod_base = OTHER; note = 2'-O-methylcytidine
  modified_base 27: mod_base = OTHER; note = 2'-O-methyluridine
  modified_base 28: mod_base = OTHER; note = 2'-O-methylcytidine
  modified_base 29: mod_base = OTHER; note = 2'-O-methyluridine
  modified_base 30: mod_base = OTHER; note = 2'-O-methylguanosine
  modified_base 31: mod_base = OTHER; note = 2'-O-methyluridine
  modified_base 32: mod_base = OTHER; note = 2'-O-methylguanosine
  modified_base 33: mod_base = OTHER; note = 2'-O-methylguanosine
  modified_base 34: mod_base = OTHER; note = 2'-O-methyladenosine

SEQ ID NO: 779 - RNA, 34 nt, synthetic construct; identical to SEQ ID NO: 527
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylguanosine
  modified_base 4: mod_base = OTHER; note = 2'-O-methyladenosine
  modified_base 5: mod_base = OTHER; note = 2'-O-methyluridine
  modified_base 6: mod_base = OTHER; note = 2'-O-methylcytidine
  modified_base 7: mod_base = OTHER; note = 2'-O-methylcytidine
  modified_base 8: mod_base = OTHER; note = 2'-O-methyladenosine
  modified_base 9: mod_base = OTHER; note = 2'-O-methyluridine
  modified_base 10: mod_base = OTHER; note = 2'-O-methylcytidine
  modified_base 11: mod_base = OTHER; note = 2'-O-methyluridine
  modified_base 12: mod_base = OTHER; note = 2'-O-methyladenosine
  modified_base 13: mod_base = OTHER; note = 2'-O-methylguanosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-O-methylcytidine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methylguanosine
  modified_base 20: mod_base = OTHER; note = 2'-O-methyluridine
  modified_base 21: mod_base = OTHER; note = 2'-O-methylguanosine
  modified_base 22: mod_base = OTHER; note = 2'-fluorocytidine
  modified_base 23: mod_base = OTHER; note = 2'-fluorouridine
  modified_base 24: mod_base = OTHER; note = 2'-fluoroadenosine
  modified_base 25: mod_base = OTHER; note = 2'-O-methylguanosine
  modified_base 26: mod_base = OTHER; note = 2'-O-methyladenosine
  modified_base 27: mod_base = OTHER; note = 2'-O-methyluridine
  modified_base 28: mod_base = OTHER; note = 2'-O-methylguanosine
  modified_base 29: mod_base = OTHER; note = 2'-O-methylguanosine
  modified_base 30: mod_base = OTHER; note = 2'-O-methyladenosine
  modified_base 31: mod_base = OTHER; note = 2'-O-methyluridine
  modified_base 32: mod_base = OTHER; note = 2'-O-methylcytidine
  modified_base 33: mod_base = OTHER; note = 2'-O-methyladenosine
  modified_base 34: mod_base = OTHER; note = 2'-O-methyladenosine

SEQ ID NO: 780 - RNA, 34 nt, synthetic construct; identical to SEQ ID NO: 528
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylcytidine
  modified_base 4: mod_base = OTHER; note = 2'-O-methylcytidine
  modified_base 5: mod_base = OTHER; note = 2'-O-methyluridine
  modified_base 6: mod_base = OTHER; note = 2'-O-methylcytidine
  modified_base 7: mod_base = OTHER; note = 2'-O-methylcytidine
  modified_base 8: mod_base = OTHER; note = 2'-O-methyluridine
  modified_base 9: mod_base = OTHER; note = 2'-O-methyluridine
  modified_base 10: mod_base = OTHER; note = 2'-O-methylcytidine
  modified_base 11: mod_base = OTHER; note = 2'-O-methylcytidine
  modified_base 12: mod_base = OTHER; note = 2'-O-methylguanosine
  modified_base 13: mod_base = OTHER; note = 2'-O-methyladenosine
  modified_base 14: mod_base = OTHER; note = 2'-fluoroguanosine
  modified_base 15: mod_base = OTHER; note = 2'-O-methyluridine
  modified_base 16: mod_base = OTHER; note = 2'-O-methylcytidine
  modified_base 17: mod_base = OTHER; note = 2'-O-methyladenosine
  modified_base 18: mod_base = OTHER; note = 2'-O-methylguanosine
  modified_base 19: mod_base = OTHER; note = 2'-O-methylcytidine
  modified_base 20: mod_base = OTHER; note = 2'-O-methyladenosine
  modified_base 21: mod_base = OTHER; note = 2'-O-methylcytidine
  modified_base 22: mod_base = OTHER; note = 2'-fluorouridine
  modified_base 23: mod_base = OTHER; note = 2'-fluorocytidine
  modified_base 24: mod_base = OTHER; note = 2'-fluoroguanosine
  modified_base 25: mod_base = OTHER; note = 2'-O-methylguanosine
  modified_base 26: mod_base = OTHER; note = 2'-O-methyladenosine
  modified_base 27: mod_base = OTHER; note = 2'-O-methyladenosine
  modified_base 28: mod_base = OTHER; note = 2'-O-methylguanosine
  modified_base 29: mod_base = OTHER; note = 2'-O-methylguanosine
  modified_base 30: mod_base = OTHER; note = 2'-O-methyladenosine
  modified_base 31: mod_base = OTHER; note = 2'-O-methylguanosine
  modified_base 32: mod_base = OTHER; note = 2'-O-methylguanosine
  modified_base 33: mod_base = OTHER; note = 2'-O-methyluridine
  modified_base 34: mod_base = OTHER; note = 2'-O-methyladenosine

SEQ ID NO: 781 - RNA, 34 nt, synthetic construct; identical to SEQ ID NO: 529
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylcytidine
  modified_base 4: mod_base = OTHER; note = 2'-O-methyluridine
  modified_base 5: mod_base = OTHER; note = 2'-O-methylguanosine
  modified_base 6: mod_base = OTHER; note = 2'-O-methyladenosine
  modified_base 7: mod_base = OTHER; note = 2'-O-methyluridine
  modified_base 8: mod_base = OTHER; note = 2'-O-methylcytidine
  modified_base 9: mod_base = OTHER; note = 2'-O-methylcytidine
  modified_base 10: mod_base = OTHER; note = 2'-O-methyladenosine
  modified_base 11: mod_base = OTHER; note = 2'-O-methyluridine
  modified_base 12: mod_base = OTHER; note = 2'-O-methylcytidine
  modified_base 13: mod_base = OTHER; note = 2'-O-methyluridine
  modified_base 14: mod_base = OTHER; note = 2'-fluoroadenosine
  modified_base 15: mod_base = OTHER; note = 2'-O-methylguanosine
  modified_base 16: mod_base = OTHER; note = 2'-O-methylcytidine
  modified_base 17: mod_base = OTHER; note = 2'-O-methyladenosine
  modified_base 18: mod_base = OTHER; note = 2'-O-methylcytidine
  modified_base 19: mod_base = OTHER; note = 2'-O-methylcytidine
  modified_base 20: mod_base = OTHER; note = 2'-O-methylcytidine
  modified_base 21: mod_base = OTHER; note = 2'-O-methyluridine
  modified_base 22: mod_base = OTHER; note = 2'-fluoroadenosine
  modified_base 23: mod_base = OTHER; note = 2'-fluoroguanosine
  modified_base 24: mod_base = OTHER; note = 2'-fluoroadenosine
  modified_base 25: mod_base = OTHER; note = 2'-O-methyluridine
  modified_base 26: mod_base = OTHER; note = 2'-O-methylguanosine
  modified_base 27: mod_base = OTHER; note = 2'-O-methylguanosine
  modified_base 28: mod_base = OTHER; note = 2'-O-methyladenosine
  modified_base 29: mod_base = OTHER; note = 2'-O-methyluridine
  modified_base 30: mod_base = OTHER; note = 2'-O-methylcytidine
  modified_base 31: mod_base = OTHER; note = 2'-O-methyladenosine
  modified_base 32: mod_base = OTHER; note = 2'-O-methylguanosine
  modified_base 33: mod_base = OTHER; note = 2'-O-methyladenosine
  modified_base 34: mod_base = OTHER; note = 2'-O-methyladenosine

SEQ ID NO: 782 - RNA, 34 nt, synthetic construct; identical to SEQ ID NO: 530
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylcytidine
  modified_base 4: mod_base = OTHER; note = 2'-O-methyluridine
  modified_base 5: mod_base = OTHER; note = 2'-O-methyluridine
  modified_base 6: mod_base = OTHER; note = 2'-O-methylguanosine
  modified_base 7: mod_base = OTHER; note = 2'-O-methylguanosine
  modified_base 8: mod_base = OTHER; note = 2'-O-methylcytidine
  modified_base 9: mod_base = OTHER; note = 2'-O-methyladenosine
  modified_base 10: mod_base = OTHER; note = 2'-O-methylguanosine
  modified_base 11: mod_base = OTHER; note = 2'-O-methylguanosine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-fluoroguanosine
  modified_base 15: mod_base = OTHER; note = 2'-O-methylguanosine
  modified_base 16: mod_base = OTHER; note = 2'-O-methylcytidine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methylcytidine
  modified_base 20: mod_base = OTHER; note = 2'-O-methylcytidine
  modified_base 21: mod_base = OTHER; note = 2'-O-methylcytidine
  modified_base 22: mod_base = OTHER; note = 2'-fluorouridine
  modified_base 23: mod_base = OTHER; note = 2'-fluorouridine
  modified_base 24: mod_base = OTHER; note = 2'-fluorocytidine
  modified_base 25: mod_base = OTHER; note = 2'-O-methylcytidine
  modified_base 26: mod_base = OTHER; note = 2'-O-methyluridine
  modified_base 27: mod_base = OTHER; note = 2'-O-methylguanosine
  modified_base 28: mod_base = OTHER; note = 2'-O-methylcytidine
  modified_base 29: mod_base = OTHER; note = 2'-O-methylcytidine
  modified_base 30: mod_base = OTHER; note = 2'-O-methyladenosine
  modified_base 31: mod_base = OTHER; note = 2'-O-methyladenosine
  modified_base 32: mod_base = OTHER; note = 2'-O-methylguanosine
  modified_base 33: mod_base = OTHER; note = 2'-O-methyladenosine
  modified_base 34: mod_base = OTHER; note = 2'-O-methyladenosine

SEQ ID NO: 783 - RNA, 34 nt, synthetic construct; identical to SEQ ID NO: 531
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylcytidine
  modified_base 4: mod_base = OTHER; note = 2'-O-methyluridine
  modified_base 5: mod_base = OTHER; note = 2'-O-methyladenosine
  modified_base 6: mod_base = OTHER; note = 2'-O-methylguanosine
  modified_base 7: mod_base = OTHER; note = 2'-O-methylcytidine
  modified_base 8: mod_base = OTHER; note = 2'-O-methyladenosine
  modified_base 9: mod_base = OTHER; note = 2'-O-methylcytidine
  modified_base 10: mod_base = OTHER; note = 2'-O-methylcytidine
  modified_base 11: mod_base = OTHER; note = 2'-O-methyladenosine
  modified_base 12: mod_base = OTHER; note = 2'-O-methylguanosine
  modified_base 13: mod_base = OTHER; note = 2'-O-methylguanosine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-O-methylguanosine
  modified_base 17: mod_base = OTHER; note = 2'-O-methyladenosine
  modified_base 18: mod_base = OTHER; note = 2'-O-methyluridine
  modified_base 19: mod_base = OTHER; note = 2'-O-methylguanosine
  modified_base 20: mod_base = OTHER; note = 2'-O-methyluridine
  modified_base 21: mod_base = OTHER; note = 2'-O-methyladenosine
  modified_base 22: mod_base = OTHER; note = 2'-fluorocytidine
  modified_base 23: mod_base = OTHER; note = 2'-fluorocytidine
  modified_base 24: mod_base = OTHER; note = 2'-fluorouridine
  modified_base 25: mod_base = OTHER; note = 2'-O-methylguanosine
  modified_base 26: mod_base = OTHER; note = 2'-O-methylguanosine
  modified_base 27: mod_base = OTHER; note = 2'-O-methyluridine
  modified_base 28: mod_base = OTHER; note = 2'-O-methylguanosine
  modified_base 29: mod_base = OTHER; note = 2'-O-methylcytidine
  modified_base 30: mod_base = OTHER; note = 2'-O-methyluridine
  modified_base 31: mod_base = OTHER; note = 2'-O-methyladenosine
  modified_base 32: mod_base = OTHER; note = 2'-O-methylguanosine
  modified_base 33: mod_base = OTHER; note = 2'-O-methyladenosine
  modified_base 34: mod_base = OTHER; note = 2'-O-methyladenosine

SEQ ID NO: 784 - RNA, 34 nt, synthetic construct; identical to SEQ ID NO: 532
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-O-methylguanosine
  modified_base 5: mod_base = OTHER; note = 2'-O-methyluridine
  modified_base 6: mod_base = OTHER; note = 2'-O-methyladenosine
  modified_base 7: mod_base = OTHER; note = 2'-O-methylcytidine
  modified_base 8: mod_base = OTHER; note = 2'-O-methyluridine
  modified_base 9: mod_base = OTHER; note = 2'-O-methylcytidine
  modified_base 10: mod_base = OTHER; note = 2'-O-methyladenosine
  modified_base 11: mod_base = OTHER; note = 2'-O-methylguanosine
  modified_base 12: mod_base = OTHER; note = 2'-O-methyladenosine
  modified_base 13: mod_base = OTHER; note = 2'-O-methylcytidine
  modified_base 14: mod_base = OTHER; note = 2'-fluoroadenosine
  modified_base 15: mod_base = OTHER; note = 2'-O-methylcytidine
  modified_base 16: mod_base = OTHER; note = 2'-O-methylcytidine
  modified_base 17: mod_base = OTHER; note = 2'-O-methyladenosine
  modified_base 18: mod_base = OTHER; note = 2'-O-methylcytidine
  modified_base 19: mod_base = OTHER; note = 2'-O-methyladenosine
  modified_base 20: mod_base = OTHER; note = 2'-O-methylguanosine
  modified_base 21: mod_base = OTHER; note = 2'-O-methyluridine
  modified_base 22: mod_base = OTHER; note = 2'-fluoroguanosine
  modified_base 23: mod_base = OTHER; note = 2'-fluorouridine
  modified_base 24: mod_base = OTHER; note = 2'-fluorocytidine
  modified_base 25: mod_base = OTHER; note = 2'-O-methyluridine
  modified_base 26: mod_base = OTHER; note = 2'-O-methylguanosine
  modified_base 27: mod_base = OTHER; note = 2'-O-methyladenosine
  modified_base 28: mod_base = OTHER; note = 2'-O-methylguanosine
  modified_base 29: mod_base = OTHER; note = 2'-O-methyluridine
  modified_base 30: mod_base = OTHER; note = 2'-O-methyladenosine
  modified_base 31: mod_base = OTHER; note = 2'-O-methylcytidine
  modified_base 32: mod_base = OTHER; note = 2'-O-methyluridine
  modified_base 33: mod_base = OTHER; note = 2'-O-methyluridine
  modified_base 34: mod_base = OTHER; note = 2'-O-methyladenosine

SEQ ID NO: 785 - RNA, 34 nt, synthetic construct; identical to SEQ ID NO: 533
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylguanosine
  modified_base 4: mod_base = OTHER; note = 2'-O-methyluridine
  modified_base 5: mod_base = OTHER; note = 2'-O-methylcytidine
  modified_base 6: mod_base = OTHER; note = 2'-O-methyluridine
  modified_base 7: mod_base = OTHER; note = 2'-O-methylguanosine
  modified_base 8: mod_base = OTHER; note = 2'-O-methyladenosine
  modified_base 9: mod_base = OTHER; note = 2'-O-methyluridine
  modified_base 10: mod_base = OTHER; note = 2'-O-methylcytidine
  modified_base 11: mod_base = OTHER; note = 2'-O-methylcytidine
  modified_base 12: mod_base = OTHER; note = 2'-O-methyladenosine
  modified_base 13: mod_base = OTHER; note = 2'-O-methyluridine
  modified_base 14: mod_base = OTHER; note = 2'-fluorocytidine
  modified_base 15: mod_base = OTHER; note = 2'-O-methyluridine
  modified_base 16: mod_base = OTHER; note = 2'-O-methyladenosine
  modified_base 17: mod_base = OTHER; note = 2'-O-methylguanosine
  modified_base 18: mod_base = OTHER; note = 2'-O-methylcytidine
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methylguanosine
  modified_base 22: mod_base = OTHER; note = 2'-fluoroadenosine
  modified_base 23: mod_base = OTHER; note = 2'-fluorouridine
  modified_base 24: mod_base = OTHER; note = 2'-fluoroguanosine
  modified_base 25: mod_base = OTHER; note = 2'-O-methylguanosine
  modified_base 26: mod_base = OTHER; note = 2'-O-methyladenosine
  modified_base 27: mod_base = OTHER; note = 2'-O-methyluridine
  modified_base 28: mod_base = OTHER; note = 2'-O-methylcytidine
  modified_base 29: mod_base = OTHER; note = 2'-O-methyladenosine
  modified_base 30: mod_base = OTHER; note = 2'-O-methylguanosine
  modified_base 31: mod_base = OTHER; note = 2'-O-methyladenosine
  modified_base 32: mod_base = OTHER; note = 2'-O-methylcytidine
  modified_base 33: mod_base = OTHER; note = 2'-O-methyladenosine
  modified_base 34: mod_base = OTHER; note = 2'-O-methyladenosine

SEQ ID NO: 786 - RNA, 34 nt, synthetic construct; identical to SEQ ID NO: 534
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyluridine
  modified_base 4: mod_base = OTHER; note = 2'-O-methylcytidine
  modified_base 5: mod_base = OTHER; note = 2'-O-methyluridine
  modified_base 6: mod_base = OTHER; note = 2'-O-methyladenosine
  modified_base 7: mod_base = OTHER; note = 2'-O-methylguanosine
  modified_base 8: mod_base = OTHER; note = 2'-O-methylcytidine
  modified_base 9: mod_base = OTHER; note = 2'-O-methyladenosine
  modified_base 10: mod_base = OTHER; note = 2'-O-methylcytidine
  modified_base 11: mod_base = OTHER; note = 2'-O-methylcytidine
  modified_base 12: mod_base = OTHER; note = 2'-O-methyladenosine
  modified_base 13: mod_base = OTHER; note = 2'-O-methylguanosine
  modified_base 14: mod_base = OTHER; note = 2'-fluoroguanosine
  modified_base 15: mod_base = OTHER; note = 2'-O-methyluridine
  modified_base 16: mod_base = OTHER; note = 2'-O-methyladenosine
  modified_base 17: mod_base = OTHER; note = 2'-O-methylguanosine
  modified_base 18: mod_base = OTHER; note = 2'-O-methyladenosine
  modified_base 19: mod_base = OTHER; note = 2'-O-methyluridine
  modified_base 20: mod_base = OTHER; note = 2'-O-methyladenosine
  modified_base 21: mod_base = OTHER; note = 2'-O-methylcytidine
  modified_base 22: mod_base = OTHER; note = 2'-fluorocytidine
  modified_base 23: mod_base = OTHER; note = 2'-fluorouridine
  modified_base 24: mod_base = OTHER; note = 2'-fluoroguanosine
  modified_base 25: mod_base = OTHER; note = 2'-O-methylguanosine
  modified_base 26: mod_base = OTHER; note = 2'-O-methyluridine
  modified_base 27: mod_base = OTHER; note = 2'-O-methylguanosine
  modified_base 28: mod_base = OTHER; note = 2'-O-methylcytidine
  modified_base 29: mod_base = OTHER; note = 2'-O-methyluridine
  modified_base 30: mod_base = OTHER; note = 2'-O-methyladenosine
  modified_base 31: mod_base = OTHER; note = 2'-O-methylguanosine
  modified_base 32: mod_base = OTHER; note = 2'-O-methyladenosine
  modified_base 33: mod_base = OTHER; note = 2'-O-methyluridine
  modified_base 34: mod_base = OTHER; note = 2'-O-methyladenosine

SEQ ID NO: 787 - RNA, 34 nt, synthetic construct; identical to SEQ ID NO: 535
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyluridine
  modified_base 7: mod_base = OTHER; note = 2'-O-methylcytidine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methylcytidine
  modified_base 11: mod_base = OTHER; note = 2'-O-methyladenosine
  modified_base 12: mod_base = OTHER; note = 2'-O-methyluridine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methyluridine
  modified_base 16: mod_base = OTHER; note = 2'-O-methylguanosine
  modified_base 17: mod_base = OTHER; note = 2'-O-methylguanosine
  modified_base 18: mod_base = OTHER; note = 2'-O-methyladenosine
  modified_base 19: mod_base = OTHER; note = 2'-O-methylguanosine
  modified_base 20: mod_base = OTHER; note = 2'-O-methyladenosine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluoroadenosine
  modified_base 24: mod_base = OTHER; note = 2'-fluorouridine
  modified_base 25: mod_base = OTHER; note = 2'-O-methylguanosine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methylguanosine
  modified_base 29: mod_base = OTHER; note = 2'-O-methyladenosine
  modified_base 30: mod_base = OTHER; note = 2'-O-methyluridine
  modified_base 31: mod_base = OTHER; note = 2'-O-methyluridine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 788 - RNA, 34 nt, synthetic construct; identical to SEQ ID NO: 536
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyluridine
  modified_base 4: mod_base = OTHER; note = 2'-O-methyladenosine
  modified_base 5: mod_base = OTHER; note = 2'-O-methylguanosine
  modified_base 6: mod_base = OTHER; note = 2'-O-methyluridine
  modified_base 7: mod_base = OTHER; note = 2'-O-methylcytidine
  modified_base 8: mod_base = OTHER; note = 2'-O-methyladenosine
  modified_base 9: mod_base = OTHER; note = 2'-O-methyluridine
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyluridine
  modified_base 16: mod_base = OTHER; note = 2'-O-methylcytidine
  modified_base 17: mod_base = OTHER; note = 2'-O-methyladenosine
  modified_base 18: mod_base = OTHER; note = 2'-O-methylguanosine
  modified_base 19: mod_base = OTHER; note = 2'-O-methylguanosine
  modified_base 20: mod_base = OTHER; note = 2'-O-methyladenosine
  modified_base 21: mod_base = OTHER; note = 2'-O-methyladenosine
  modified_base 22: mod_base = OTHER; note = 2'-fluorouridine
  modified_base 23: mod_base = OTHER; note = 2'-fluorouridine
  modified_base 24: mod_base = OTHER; note = 2'-fluorouridine
  modified_base 25: mod_base = OTHER; note = 2'-O-methyluridine
  modified_base 26: mod_base = OTHER; note = 2'-O-methyladenosine
  modified_base 27: mod_base = OTHER; note = 2'-O-methyluridine
  modified_base 28: mod_base = OTHER; note = 2'-O-methylguanosine
  modified_base 29: mod_base = OTHER; note = 2'-O-methyladenosine
  modified_base 30: mod_base = OTHER; note = 2'-O-methylcytidine
  modified_base 31: mod_base = OTHER; note = 2'-O-methyluridine
  modified_base 32: mod_base = OTHER; note = 2'-O-methyladenosine
  modified_base 33: mod_base = OTHER; note = 2'-O-methyluridine
  modified_base 34: mod_base = OTHER; note = 2'-O-methyladenosine

SEQ ID NO: 789 - RNA, 34 nt, synthetic construct; identical to SEQ ID NO: 537
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylguanosine
  modified_base 4: mod_base = OTHER; note = 2'-O-methylguanosine
  modified_base 5: mod_base = OTHER; note = 2'-O-methyladenosine
  modified_base 6: mod_base = OTHER; note = 2'-O-methyluridine
  modified_base 7: mod_base = OTHER; note = 2'-O-methylguanosine
  modified_base 8: mod_base = OTHER; note = 2'-O-methyladenosine
  modified_base 9: mod_base = OTHER; note = 2'-O-methyluridine
  modified_base 10: mod_base = OTHER; note = 2'-O-methylguanosine
  modified_base 11: mod_base = OTHER; note = 2'-O-methyladenosine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methylguanosine
  modified_base 17: mod_base = OTHER; note = 2'-O-methylcytidine
  modified_base 18: mod_base = OTHER; note = 2'-O-methylguanosine
  modified_base 19: mod_base = OTHER; note = 2'-O-methylguanosine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluorouridine
  modified_base 25: mod_base = OTHER; note = 2'-O-methylcytidine
  modified_base 26: mod_base = OTHER; note = 2'-O-methyladenosine
  modified_base 27: mod_base = OTHER; note = 2'-O-methyluridine
  modified_base 28: mod_base = OTHER; note = 2'-O-methylcytidine
  modified_base 29: mod_base = OTHER; note = 2'-O-methyladenosine
  modified_base 30: mod_base = OTHER; note = 2'-O-methyluridine
  modified_base 31: mod_base = OTHER; note = 2'-O-methylcytidine
  modified_base 32: mod_base = OTHER; note = 2'-O-methylcytidine
  modified_base 33: mod_base = OTHER; note = 2'-O-methyluridine
  modified_base 34: mod_base = OTHER; note = 2'-O-methyladenosine

SEQ ID NO: 790 - RNA, 34 nt, synthetic construct; identical to SEQ ID NO: 538
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methyluridine
  modified_base 6: mod_base = OTHER; note = 2'-O-methylcytidine
  modified_base 7: mod_base = OTHER; note = 2'-O-methyluridine
  modified_base 8: mod_base = OTHER; note = 2'-O-methylguanosine
  modified_base 9: mod_base = OTHER; note = 2'-O-methyluridine
  modified_base 10: mod_base = OTHER; note = 2'-O-methylguanosine
  modified_base 11: mod_base = OTHER; note = 2'-O-methyluridine
  modified_base 12: mod_base = OTHER; note = 2'-O-methyluridine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methylguanosine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methylcytidine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluoroadenosine
  modified_base 24: mod_base = OTHER; note = 2'-fluoroadenosine
  modified_base 25: mod_base = OTHER; note = 2'-O-methylcytidine
  modified_base 26: mod_base = OTHER; note = 2'-O-methyladenosine
  modified_base 27: mod_base = OTHER; note = 2'-O-methylcytidine
  modified_base 28: mod_base = OTHER; note = 2'-O-methyladenosine
  modified_base 29: mod_base = OTHER; note = 2'-O-methylguanosine
  modified_base 30: mod_base = OTHER; note = 2'-O-methyladenosine
  modified_base 31: mod_base = OTHER; note = 2'-O-methyluridine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 791 - RNA, 34 nt, synthetic construct; identical to SEQ ID NO: 539
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylguanosine
  modified_base 4: mod_base = OTHER; note = 2'-O-methyladenosine
  modified_base 5: mod_base = OTHER; note = 2'-O-methylguanosine
  modified_base 6: mod_base = OTHER; note = 2'-O-methylcytidine
  modified_base 7: mod_base = OTHER; note = 2'-O-methyluridine
  modified_base 8: mod_base = OTHER; note = 2'-O-methyluridine
  modified_base 9: mod_base = OTHER; note = 2'-O-methylguanosine
  modified_base 10: mod_base = OTHER; note = 2'-O-methyladenosine
  modified_base 11: mod_base = OTHER; note = 2'-O-methyluridine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluoroguanosine
  modified_base 15: mod_base = OTHER; note = 2'-O-methylguanosine
  modified_base 16: mod_base = OTHER; note = 2'-O-methylguanosine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methyladenosine
  modified_base 20: mod_base = OTHER; note = 2'-O-methylcytidine
  modified_base 21: mod_base = OTHER; note = 2'-O-methylcytidine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluoroadenosine
  modified_base 25: mod_base = OTHER; note = 2'-O-methyluridine
  modified_base 26: mod_base = OTHER; note = 2'-O-methylcytidine
  modified_base 27: mod_base = OTHER; note = 2'-O-methyladenosine
  modified_base 28: mod_base = OTHER; note = 2'-O-methyladenosine
  modified_base 29: mod_base = OTHER; note = 2'-O-methylguanosine
  modified_base 30: mod_base = OTHER; note = 2'-O-methylcytidine
  modified_base 31: mod_base = OTHER; note = 2'-O-methyluridine
  modified_base 32: mod_base = OTHER; note = 2'-O-methylcytidine
  modified_base 33: mod_base = OTHER; note = 2'-O-methyladenosine
  modified_base 34: mod_base = OTHER; note = 2'-O-methyladenosine

SEQ ID NO: 792 - RNA, 34 nt, synthetic construct; identical to SEQ ID NO: 540
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylguanosine
  modified_base 4: mod_base = OTHER; note = 2'-O-methyluridine
  modified_base 5: mod_base = OTHER; note = 2'-O-methylguanosine
  modified_base 6: mod_base = OTHER; note = 2'-O-methylguanosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methylguanosine
  modified_base 11: mod_base = OTHER; note = 2'-O-methyladenosine
  modified_base 12: mod_base = OTHER; note = 2'-O-methylguanosine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methylcytidine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methyluridine
  modified_base 20: mod_base = OTHER; note = 2'-O-methylguanosine
  modified_base 21: mod_base = OTHER; note = 2'-O-methyladenosine
  modified_base 22: mod_base = OTHER; note = 2'-fluorouridine
  modified_base 23: mod_base = OTHER; note = 2'-fluorocytidine
  modified_base 24: mod_base = OTHER; note = 2'-fluorouridine
  modified_base 25: mod_base = OTHER; note = 2'-O-methylcytidine
  modified_base 26: mod_base = OTHER; note = 2'-O-methyluridine
  modified_base 27: mod_base = OTHER; note = 2'-O-methyluridine
  modified_base 28: mod_base = OTHER; note = 2'-O-methyluridine
  modified_base 29: mod_base = OTHER; note = 2'-O-methylcytidine
  modified_base 30: mod_base = OTHER; note = 2'-O-methylcytidine
  modified_base 31: mod_base = OTHER; note = 2'-O-methyladenosine
  modified_base 32: mod_base = OTHER; note = 2'-O-methylcytidine
  modified_base 33: mod_base = OTHER; note = 2'-O-methyluridine
  modified_base 34: mod_base = OTHER; note = 2'-O-methyladenosine

SEQ ID NO: 793 - RNA, 34 nt, synthetic construct; identical to SEQ ID NO: 541
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylguanosine
  modified_base 4: mod_base = OTHER; note = 2'-O-methyladenosine
  modified_base 5: mod_base = OTHER; note = 2'-O-methyluridine
  modified_base 6: mod_base = OTHER; note = 2'-O-methylguanosine
  modified_base 7: mod_base = OTHER; note = 2'-O-methyluridine
  modified_base 8: mod_base = OTHER; note = 2'-O-methyluridine
  modified_base 9: mod_base = OTHER; note = 2'-O-methylcytidine
  modified_base 10: mod_base = OTHER; note = 2'-O-methyladenosine
  modified_base 11: mod_base = OTHER; note = 2'-O-methyluridine
  modified_base 12: mod_base = OTHER; note = 2'-O-methylguanosine
  modified_base 13: mod_base = OTHER; note = 2'-O-methylguanosine
  modified_base 14: mod_base = OTHER; note = 2'-fluoroadenosine
  modified_base 15: mod_base = OTHER; note = 2'-O-methylguanosine
  modified_base 16: mod_base = OTHER; note = 2'-O-methylcytidine
  modified_base 17: mod_base = OTHER; note = 2'-O-methylcytidine
  modified_base 18: mod_base = OTHER; note = 2'-O-methyluridine
  modified_base 19: mod_base = OTHER; note = 2'-O-methylguanosine
  modified_base 20: mod_base = OTHER; note = 2'-O-methylcytidine
  modified_base 21: mod_base = OTHER; note = 2'-O-methyluridine
  modified_base 22: mod_base = OTHER; note = 2'-fluorocytidine
  modified_base 23: mod_base = OTHER; note = 2'-fluorocytidine
  modified_base 24: mod_base = OTHER; note = 2'-fluoroadenosine
  modified_base 25: mod_base = OTHER; note = 2'-O-methyluridine
  modified_base 26: mod_base = OTHER; note = 2'-O-methylguanosine
  modified_base 27: mod_base = OTHER; note = 2'-O-methyladenosine
  modified_base 28: mod_base = OTHER; note = 2'-O-methyladenosine
  modified_base 29: mod_base = OTHER; note = 2'-O-methylcytidine
  modified_base 30: mod_base = OTHER; note = 2'-O-methyladenosine
  modified_base 31: mod_base = OTHER; note = 2'-O-methyluridine
  modified_base 32: mod_base = OTHER; note = 2'-O-methylcytidine
  modified_base 33: mod_base = OTHER; note = 2'-O-methyluridine
  modified_base 34: mod_base = OTHER; note = 2'-O-methyladenosine

SEQ ID NO: 794 - RNA, 34 nt, synthetic construct; identical to SEQ ID NO: 542
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methylcytidine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methylguanosine
  modified_base 7: mod_base = OTHER; note = 2'-O-methyluridine
  modified_base 8: mod_base = OTHER; note = 2'-O-methylguanosine
  modified_base 9: mod_base = OTHER; note = 2'-O-methylguanosine
  modified_base 10: mod_base = OTHER; note = 2'-O-methyluridine
  modified_base 11: mod_base = OTHER; note = 2'-O-methyladenosine
  modified_base 12: mod_base = OTHER; note = 2'-O-methylguanosine
  modified_base 13: mod_base = OTHER; note = 2'-O-methyluridine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methylguanosine
  modified_base 17: mod_base = OTHER; note = 2'-O-methyladenosine
  modified_base 18: mod_base = OTHER; note = 2'-O-methylguanosine
  modified_base 19: mod_base = OTHER; note = 2'-O-methylguanosine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluoroadenosine
  modified_base 23: mod_base = OTHER; note = 2'-fluorocytidine
  modified_base 24: mod_base = OTHER; note = 2'-fluorouridine
  modified_base 25: mod_base = OTHER; note = 2'-O-methyladenosine
  modified_base 26: mod_base = OTHER; note = 2'-O-methylcytidine
  modified_base 27: mod_base = OTHER; note = 2'-O-methylcytidine
  modified_base 28: mod_base = OTHER; note = 2'-O-methyladenosine
  modified_base 29: mod_base = OTHER; note = 2'-O-methylcytidine
  modified_base 30: mod_base = OTHER; note = 2'-O-methyluridine
  modified_base 31: mod_base = OTHER; note = 2'-O-methyluridine
  modified_base 32: mod_base = OTHER; note = 2'-O-methylguanosine
  modified_base 33: mod_base = OTHER; note = 2'-O-methylcytidine
  modified_base 34: mod_base = OTHER; note = 2'-O-methyladenosine

SEQ ID NO: 795 - RNA, 34 nt, synthetic construct; identical to SEQ ID NO: 543
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methylcytidine
  modified_base 5: mod_base = OTHER; note = 2'-O-methyladenosine
  modified_base 6: mod_base = OTHER; note = 2'-O-methylcytidine
  modified_base 7: mod_base = OTHER; note = 2'-O-methylcytidine
  modified_base 8: mod_base = OTHER; note = 2'-O-methyladenosine
  modified_base 9: mod_base = OTHER; note = 2'-O-methyluridine
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-O-methylcytidine
  modified_base 13: mod_base = OTHER; note = 2'-O-methyluridine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methylcytidine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methylcytidine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluoroadenosine
  modified_base 23: mod_base = OTHER; note = 2'-fluoroguanosine
  modified_base 24: mod_base = OTHER; note = 2'-fluorouridine
  modified_base 25: mod_base = OTHER; note = 2'-O-methyluridine
  modified_base 26: mod_base = OTHER; note = 2'-O-methyladenosine
  modified_base 27: mod_base = OTHER; note = 2'-O-methyluridine
  modified_base 28: mod_base = OTHER; note = 2'-O-methylguanosine
  modified_base 29: mod_base = OTHER; note = 2'-O-methylguanosine
  modified_base 30: mod_base = OTHER; note = 2'-O-methyluridine
  modified_base 31: mod_base = OTHER; note = 2'-O-methylguanosine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 796 - RNA, 34 nt, synthetic construct; identical to SEQ ID NO: 544
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methylguanosine
  modified_base 6: mod_base = OTHER; note = 2'-O-methyladenosine
  modified_base 7: mod_base = OTHER; note = 2'-O-methylguanosine
  modified_base 8: mod_base = OTHER; note = 2'-O-methyladenosine
  modified_base 9: mod_base = OTHER; note = 2'-O-methyluridine
  modified_base 10: mod_base = OTHER; note = 2'-O-methylcytidine
  modified_base 11: mod_base = OTHER; note = 2'-O-methyluridine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methylcytidine
  modified_base 16: mod_base = OTHER; note = 2'-O-methyladenosine
  modified_base 17: mod_base = OTHER; note = 2'-O-methylcytidine
  modified_base 18: mod_base = OTHER; note = 2'-O-methyluridine
  modified_base 19: mod_base = OTHER; note = 2'-O-methylcytidine
  modified_base 20: mod_base = OTHER; note = 2'-O-methylguanosine
  modified_base 21: mod_base = OTHER; note = 2'-O-methyladenosine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluoroadenosine
  modified_base 25: mod_base = OTHER; note = 2'-O-methylguanosine
  modified_base 26: mod_base = OTHER; note = 2'-O-methyladenosine
  modified_base 27: mod_base = OTHER; note = 2'-O-methyluridine
  modified_base 28: mod_base = OTHER; note = 2'-O-methylcytidine
  modified_base 29: mod_base = OTHER; note = 2'-O-methyluridine
  modified_base 30: mod_base = OTHER; note = 2'-O-methylcytidine
  modified_base 31: mod_base = OTHER; note = 2'-O-methyluridine
  modified_base 32: mod_base = OTHER; note = 2'-O-methyluridine
  modified_base 33: mod_base = OTHER; note = 2'-O-methyluridine
  modified_base 34: mod_base = OTHER; note = 2'-O-methyladenosine

SEQ ID NO: 797 - RNA, 34 nt, synthetic construct; identical to SEQ ID NO: 545
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylcytidine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methylcytidine
  modified_base 7: mod_base = OTHER; note = 2'-O-methyluridine
  modified_base 8: mod_base = OTHER; note = 2'-O-methyluridine
  modified_base 9: mod_base = OTHER; note = 2'-O-methylguanosine
  modified_base 10: mod_base = OTHER; note = 2'-O-methyluridine
  modified_base 11: mod_base = OTHER; note = 2'-O-methylguanosine
  modified_base 12: mod_base = OTHER; note = 2'-O-methylguanosine
  modified_base 13: mod_base = OTHER; note = 2'-O-methyluridine
  modified_base 14: mod_base = OTHER; note = 2'-fluorocytidine
  modified_base 15: mod_base = OTHER; note = 2'-O-methyluridine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methyluridine
  modified_base 20: mod_base = OTHER; note = 2'-O-methyladenosine
  modified_base 21: mod_base = OTHER; note = 2'-O-methylguanosine
  modified_base 22: mod_base = OTHER; note = 2'-fluoroadenosine
  modified_base 23: mod_base = OTHER; note = 2'-fluorocytidine
  modified_base 24: mod_base = OTHER; note = 2'-fluorocytidine
  modified_base 25: mod_base = OTHER; note = 2'-O-methyladenosine
  modified_base 26: mod_base = OTHER; note = 2'-O-methylcytidine
  modified_base 27: mod_base = OTHER; note = 2'-O-methyladenosine
  modified_base 28: mod_base = OTHER; note = 2'-O-methyladenosine
  modified_base 29: mod_base = OTHER; note = 2'-O-methylguanosine
  modified_base 30: mod_base = OTHER; note = 2'-O-methyluridine
  modified_base 31: mod_base = OTHER; note = 2'-O-methyluridine
  modified_base 32: mod_base = OTHER; note = 2'-O-methylguanosine
  modified_base 33: mod_base = OTHER; note = 2'-O-methyladenosine
  modified_base 34: mod_base = OTHER; note = 2'-O-methyladenosine

SEQ ID NO: 798 - RNA, 34 nt, synthetic construct; identical to SEQ ID NO: 546
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methylcytidine
  modified_base 6: mod_base = OTHER; note = 2'-O-methylguanosine
  modified_base 7: mod_base = OTHER; note = 2'-O-methyladenosine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methyluridine
  modified_base 11: mod_base = OTHER; note = 2'-O-methylcytidine
  modified_base 12: mod_base = OTHER; note = 2'-O-methyluridine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methyluridine
  modified_base 16: mod_base = OTHER; note = 2'-O-methylguanosine
  modified_base 17: mod_base = OTHER; note = 2'-O-methyluridine
  modified_base 18: mod_base = OTHER; note = 2'-O-methylguanosine
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluoroadenosine
  modified_base 24: mod_base = OTHER; note = 2'-fluoroguanosine
  modified_base 25: mod_base = OTHER; note = 2'-O-methyladenosine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methyluridine
  modified_base 29: mod_base = OTHER; note = 2'-O-methylcytidine
  modified_base 30: mod_base = OTHER; note = 2'-O-methylguanosine
  modified_base 31: mod_base = OTHER; note = 2'-O-methyluridine
  modified_base 32: mod_base = OTHER; note = 2'-O-methyluridine
  modified_base 33: mod_base = OTHER; note = 2'-O-methyluridine
  modified_base 34: mod_base = OTHER; note = 2'-O-methyladenosine

SEQ ID NO: 799 - RNA, 34 nt, synthetic construct; identical to SEQ ID NO: 547
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methyluridine
  modified_base 4: mod_base = OTHER; note = 2'-O-methyladenosine
  modified_base 5: mod_base = OTHER; note = 2'-O-methyluridine
  modified_base 6: mod_base = OTHER; note = 2'-O-methylguanosine
  modified_base 7: mod_base = OTHER; note = 2'-O-methyluridine
  modified_base 8: mod_base = OTHER; note = 2'-O-methylguanosine
  modified_base 9: mod_base = OTHER; note = 2'-O-methylguanosine
  modified_base 10: mod_base = OTHER; note = 2'-O-methylcytidine
  modified_base 11: mod_base = OTHER; note = 2'-O-methyladenosine
  modified_base 12: mod_base = OTHER; note = 2'-O-methyluridine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methylcytidine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluorouridine
  modified_base 23: mod_base = OTHER; note = 2'-fluoroadenosine
  modified_base 24: mod_base = OTHER; note = 2'-fluorouridine
  modified_base 25: mod_base = OTHER; note = 2'-O-methylguanosine
  modified_base 26: mod_base = OTHER; note = 2'-O-methylcytidine
  modified_base 27: mod_base = OTHER; note = 2'-O-methylcytidine
  modified_base 28: mod_base = OTHER; note = 2'-O-methyladenosine
  modified_base 29: mod_base = OTHER; note = 2'-O-methylcytidine
  modified_base 30: mod_base = OTHER; note = 2'-O-methyladenosine
  modified_base 31: mod_base = OTHER; note = 2'-O-methyluridine
  modified_base 32: mod_base = OTHER; note = 2'-O-methyladenosine
  modified_base 33: mod_base = OTHER; note = 2'-O-methylcytidine
  modified_base 34: mod_base = OTHER; note = 2'-O-methyladenosine

SEQ ID NO: 800 - RNA, 34 nt, synthetic construct; identical to SEQ ID NO: 548
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methyluridine
  modified_base 4: mod_base = OTHER; note = 2'-O-methylcytidine
  modified_base 5: mod_base = OTHER; note = 2'-O-methyluridine
  modified_base 6: mod_base = OTHER; note = 2'-O-methyluridine
  modified_base 7: mod_base = OTHER; note = 2'-O-methyluridine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methyluridine
  modified_base 11: mod_base = OTHER; note = 2'-O-methylguanosine
  modified_base 12: mod_base = OTHER; note = 2'-O-methylguanosine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methylguanosine
  modified_base 16: mod_base = OTHER; note = 2'-O-methylcytidine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methyladenosine
  modified_base 20: mod_base = OTHER; note = 2'-O-methylcytidine
  modified_base 21: mod_base = OTHER; note = 2'-O-methyluridine
  modified_base 22: mod_base = OTHER; note = 2'-fluorouridine
  modified_base 23: mod_base = OTHER; note = 2'-fluorocytidine
  modified_base 24: mod_base = OTHER; note = 2'-fluorocytidine
  modified_base 25: mod_base = OTHER; note = 2'-O-methyladenosine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methyladenosine
  modified_base 29: mod_base = OTHER; note = 2'-O-methyladenosine
  modified_base 30: mod_base = OTHER; note = 2'-O-methyladenosine
  modified_base 31: mod_base = OTHER; note = 2'-O-methylguanosine
  modified_base 32: mod_base = OTHER; note = 2'-O-methyladenosine
  modified_base 33: mod_base = OTHER; note = 2'-O-methylcytidine
  modified_base 34: mod_base = OTHER; note = 2'-O-methyladenosine

SEQ ID NO: 801 - RNA, 34 nt, synthetic construct; identical to SEQ ID NO: 549
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methyluridine
  modified_base 5: mod_base = OTHER; note = 2'-O-methylcytidine
  modified_base 6: mod_base = OTHER; note = 2'-O-methylcytidine
  modified_base 7: mod_base = OTHER; note = 2'-O-methyladenosine
  modified_base 8: mod_base = OTHER; note = 2'-O-methylguanosine
  modified_base 9: mod_base = OTHER; note = 2'-O-methyladenosine
  modified_base 10: mod_base = OTHER; note = 2'-O-methyluridine
  modified_base 11: mod_base = OTHER; note = 2'-O-methyladenosine
  modified_base 12: mod_base = OTHER; note = 2'-O-methyladenosine
  modified_base 13: mod_base = OTHER; note = 2'-O-methyluridine
  modified_base 14: mod_base = OTHER; note = 2'-fluorocytidine
  modified_base 15: mod_base = OTHER; note = 2'-O-methylcytidine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methylcytidine
  modified_base 19: mod_base = OTHER; note = 2'-O-methylcytidine
  modified_base 20: mod_base = OTHER; note = 2'-O-methylguanosine
  modified_base 21: mod_base = OTHER; note = 2'-O-methylguanosine
  modified_base 22: mod_base = OTHER; note = 2'-fluoroadenosine
  modified_base 23: mod_base = OTHER; note = 2'-fluorouridine
  modified_base 24: mod_base = OTHER; note = 2'-fluorouridine
  modified_base 25: mod_base = OTHER; note = 2'-O-methyladenosine
  modified_base 26: mod_base = OTHER; note = 2'-O-methyluridine
  modified_base 27: mod_base = OTHER; note = 2'-O-methylcytidine
  modified_base 28: mod_base = OTHER; note = 2'-O-methyluridine
  modified_base 29: mod_base = OTHER; note = 2'-O-methylguanosine
  modified_base 30: mod_base = OTHER; note = 2'-O-methylguanosine
  modified_base 31: mod_base = OTHER; note = 2'-O-methyladenosine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 802 - RNA, 34 nt, synthetic construct; identical to SEQ ID NO: 550
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methyluridine
  modified_base 4: mod_base = OTHER; note = 2'-O-methylguanosine
  modified_base 5: mod_base = OTHER; note = 2'-O-methyladenosine
  modified_base 6: mod_base = OTHER; note = 2'-O-methylcytidine
  modified_base 7: mod_base = OTHER; note = 2'-O-methyluridine
  modified_base 8: mod_base = OTHER; note = 2'-O-methyluridine
  modified_base 9: mod_base = OTHER; note = 2'-O-methyluridine
  modified_base 10: mod_base = OTHER; note = 2'-O-methylguanosine
  modified_base 11: mod_base = OTHER; note = 2'-O-methyluridine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-O-methylguanosine
  modified_base 17: mod_base = OTHER; note = 2'-O-methylcytidine
  modified_base 18: mod_base = OTHER; note = 2'-O-methylcytidine
  modified_base 19: mod_base = OTHER; note = 2'-O-methyluridine
  modified_base 20: mod_base = OTHER; note = 2'-O-methyluridine
  modified_base 21: mod_base = OTHER; note = 2'-O-methyladenosine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluoroadenosine
  modified_base 25: mod_base = OTHER; note = 2'-O-methylcytidine
  modified_base 26: mod_base = OTHER; note = 2'-O-methyladenosine
  modified_base 27: mod_base = OTHER; note = 2'-O-methyladenosine
  modified_base 28: mod_base = OTHER; note = 2'-O-methyladenosine
  modified_base 29: mod_base = OTHER; note = 2'-O-methylguanosine
  modified_base 30: mod_base = OTHER; note = 2'-O-methyluridine
  modified_base 31: mod_base = OTHER; note = 2'-O-methylcytidine
  modified_base 32: mod_base = OTHER; note = 2'-O-methyladenosine
  modified_base 33: mod_base = OTHER; note = 2'-O-methyladenosine
  modified_base 34: mod_base = OTHER; note = 2'-O-methyladenosine

SEQ ID NO: 803 - RNA, 34 nt, synthetic construct; identical to SEQ ID NO: 551
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methylcytidine
  modified_base 6: mod_base = OTHER; note = 2'-O-methyluridine
  modified_base 7: mod_base = OTHER; note = 2'-O-methylcytidine
  modified_base 8: mod_base = OTHER; note = 2'-O-methylcytidine
  modified_base 9: mod_base = OTHER; note = 2'-O-methyladenosine
  modified_base 10: mod_base = OTHER; note = 2'-O-methylguanosine
  modified_base 11: mod_base = OTHER; note = 2'-O-methyladenosine
  modified_base 12: mod_base = OTHER; note = 2'-O-methylcytidine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-O-methylguanosine
  modified_base 17: mod_base = OTHER; note = 2'-O-methyladenosine
  modified_base 18: mod_base = OTHER; note = 2'-O-methylcytidine
  modified_base 19: mod_base = OTHER; note = 2'-O-methylcytidine
  modified_base 20: mod_base = OTHER; note = 2'-O-methyluridine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluoroguanosine
  modified_base 24: mod_base = OTHER; note = 2'-fluorouridine
  modified_base 25: mod_base = OTHER; note = 2'-O-methylcytidine
  modified_base 26: mod_base = OTHER; note = 2'-O-methyluridine
  modified_base 27: mod_base = OTHER; note = 2'-O-methylguanosine
  modified_base 28: mod_base = OTHER; note = 2'-O-methylguanosine
  modified_base 29: mod_base = OTHER; note = 2'-O-methyladenosine
  modified_base 30: mod_base = OTHER; note = 2'-O-methylguanosine
  modified_base 31: mod_base = OTHER; note = 2'-O-methyluridine
  modified_base 32: mod_base = OTHER; note = 2'-O-methyluridine
  modified_base 33: mod_base = OTHER; note = 2'-O-methyluridine
  modified_base 34: mod_base = OTHER; note = 2'-O-methyladenosine

SEQ ID NO: 804 - RNA, 34 nt, synthetic construct; identical to SEQ ID NO: 552
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyluridine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methylcytidine
  modified_base 7: mod_base = OTHER; note = 2'-O-methyluridine
  modified_base 8: mod_base = OTHER; note = 2'-O-methyluridine
  modified_base 9: mod_base = OTHER; note = 2'-O-methylguanosine
  modified_base 10: mod_base = OTHER; note = 2'-O-methylcytidine
  modified_base 11: mod_base = OTHER; note = 2'-O-methylcytidine
  modified_base 12: mod_base = OTHER; note = 2'-O-methyladenosine
  modified_base 13: mod_base = OTHER; note = 2'-O-methylcytidine
  modified_base 14: mod_base = OTHER; note = 2'-fluorocytidine
  modified_base 15: mod_base = OTHER; note = 2'-O-methyluridine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methyluridine
  modified_base 19: mod_base = OTHER; note = 2'-O-methylcytidine
  modified_base 20: mod_base = OTHER; note = 2'-O-methyladenosine
  modified_base 21: mod_base = OTHER; note = 2'-O-methylguanosine
  modified_base 22: mod_base = OTHER; note = 2'-fluoroguanosine
  modified_base 23: mod_base = OTHER; note = 2'-fluorouridine
  modified_base 24: mod_base = OTHER; note = 2'-fluoroguanosine
  modified_base 25: mod_base = OTHER; note = 2'-O-methylguanosine
  modified_base 26: mod_base = OTHER; note = 2'-O-methylcytidine
  modified_base 27: mod_base = OTHER; note = 2'-O-methyladenosine
  modified_base 28: mod_base = OTHER; note = 2'-O-methyladenosine
  modified_base 29: mod_base = OTHER; note = 2'-O-methylguanosine
  modified_base 30: mod_base = OTHER; note = 2'-O-methyluridine
  modified_base 31: mod_base = OTHER; note = 2'-O-methyluridine
  modified_base 32: mod_base = OTHER; note = 2'-O-methyladenosine
  modified_base 33: mod_base = OTHER; note = 2'-O-methyluridine
  modified_base 34: mod_base = OTHER; note = 2'-O-methyladenosine

SEQ ID NO: 805 - RNA, 34 nt, synthetic construct; identical to SEQ ID NO: 553
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methyluridine
  modified_base 5: mod_base = OTHER; note = 2'-O-methyladenosine
  modified_base 6: mod_base = OTHER; note = 2'-O-methylguanosine
  modified_base 7: mod_base = OTHER; note = 2'-O-methyluridine
  modified_base 8: mod_base = OTHER; note = 2'-O-methylcytidine
  modified_base 9: mod_base = OTHER; note = 2'-O-methyladenosine
  modified_base 10: mod_base = OTHER; note = 2'-O-methyluridine
  modified_base 11: mod_base = OTHER; note = 2'-O-methyladenosine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyluridine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methylguanosine
  modified_base 20: mod_base = OTHER; note = 2'-O-methyladenosine
  modified_base 21: mod_base = OTHER; note = 2'-O-methyluridine
  modified_base 22: mod_base = OTHER; note = 2'-fluorouridine
  modified_base 23: mod_base = OTHER; note = 2'-fluorouridine
  modified_base 24: mod_base = OTHER; note = 2'-fluorouridine
  modified_base 25: mod_base = OTHER; note = 2'-O-methyladenosine
  modified_base 26: mod_base = OTHER; note = 2'-O-methyluridine
  modified_base 27: mod_base = OTHER; note = 2'-O-methylguanosine
  modified_base 28: mod_base = OTHER; note = 2'-O-methyladenosine
  modified_base 29: mod_base = OTHER; note = 2'-O-methylcytidine
  modified_base 30: mod_base = OTHER; note = 2'-O-methyluridine
  modified_base 31: mod_base = OTHER; note = 2'-O-methyladenosine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 806 - RNA, 34 nt, synthetic construct; identical to SEQ ID NO: 554
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylguanosine
  modified_base 4: mod_base = OTHER; note = 2'-O-methylguanosine
  modified_base 5: mod_base = OTHER; note = 2'-O-methylcytidine
  modified_base 6: mod_base = OTHER; note = 2'-O-methyluridine
  modified_base 7: mod_base = OTHER; note = 2'-O-methylcytidine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methylguanosine
  modified_base 11: mod_base = OTHER; note = 2'-O-methyluridine
  modified_base 12: mod_base = OTHER; note = 2'-O-methylguanosine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methylguanosine
  modified_base 16: mod_base = OTHER; note = 2'-O-methyluridine
  modified_base 17: mod_base = OTHER; note = 2'-O-methyluridine
  modified_base 18: mod_base = OTHER; note = 2'-O-methylguanosine
  modified_base 19: mod_base = OTHER; note = 2'-O-methylcytidine
  modified_base 20: mod_base = OTHER; note = 2'-O-methylcytidine
  modified_base 21: mod_base = OTHER; note = 2'-O-methyluridine
  modified_base 22: mod_base = OTHER; note = 2'-fluorouridine
  modified_base 23: mod_base = OTHER; note = 2'-fluorocytidine
  modified_base 24: mod_base = OTHER; note = 2'-fluoroadenosine
  modified_base 25: mod_base = OTHER; note = 2'-O-methylcytidine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methylguanosine
  modified_base 29: mod_base = OTHER; note = 2'-O-methyladenosine
  modified_base 30: mod_base = OTHER; note = 2'-O-methylguanosine
  modified_base 31: mod_base = OTHER; note = 2'-O-methylcytidine
  modified_base 32: mod_base = OTHER; note = 2'-O-methylcytidine
  modified_base 33: mod_base = OTHER; note = 2'-O-methyladenosine
  modified_base 34: mod_base = OTHER; note = 2'-O-methyladenosine

SEQ ID NO: 807 - RNA, 34 nt, synthetic construct; identical to SEQ ID NO: 555
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methylguanosine
  modified_base 6: mod_base = OTHER; note = 2'-O-methyluridine
  modified_base 7: mod_base = OTHER; note = 2'-O-methyladenosine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methylcytidine
  modified_base 11: mod_base = OTHER; note = 2'-O-methyladenosine
  modified_base 12: mod_base = OTHER; note = 2'-O-methylguanosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-O-methylcytidine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methylcytidine
  modified_base 20: mod_base = OTHER; note = 2'-O-methyluridine
  modified_base 21: mod_base = OTHER; note = 2'-O-methylguanosine
  modified_base 22: mod_base = OTHER; note = 2'-fluorouridine
  modified_base 23: mod_base = OTHER; note = 2'-fluorocytidine
  modified_base 24: mod_base = OTHER; note = 2'-fluorouridine
  modified_base 25: mod_base = OTHER; note = 2'-O-methylguanosine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methyluridine
  modified_base 29: mod_base = OTHER; note = 2'-O-methyladenosine
  modified_base 30: mod_base = OTHER; note = 2'-O-methylcytidine
  modified_base 31: mod_base = OTHER; note = 2'-O-methyluridine
  modified_base 32: mod_base = OTHER; note = 2'-O-methyluridine
  modified_base 33: mod_base = OTHER; note = 2'-O-methyluridine
  modified_base 34: mod_base = OTHER; note = 2'-O-methyladenosine

SEQ ID NO: 808 - RNA, 34 nt, synthetic construct; identical to SEQ ID NO: 556
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methylcytidine
  modified_base 4: mod_base = OTHER; note = 2'-O-methyluridine
  modified_base 5: mod_base = OTHER; note = 2'-O-methylcytidine
  modified_base 6: mod_base = OTHER; note = 2'-O-methyladenosine
  modified_base 7: mod_base = OTHER; note = 2'-O-methyluridine
  modified_base 8: mod_base = OTHER; note = 2'-O-methyluridine
  modified_base 9: mod_base = OTHER; note = 2'-O-methylguanosine
  modified_base 10: mod_base = OTHER; note = 2'-O-methyluridine
  modified_base 11: mod_base = OTHER; note = 2'-O-methylcytidine
  modified_base 12: mod_base = OTHER; note = 2'-O-methyluridine
  modified_base 13: mod_base = OTHER; note = 2'-O-methyluridine
  modified_base 14: mod_base = OTHER; note = 2'-fluorouridine
  modified_base 15: mod_base = OTHER; note = 2'-O-methylcytidine
  modified_base 16: mod_base = OTHER; note = 2'-O-methyluridine
  modified_base 17: mod_base = OTHER; note = 2'-O-methyluridine
  modified_base 18: mod_base = OTHER; note = 2'-O-methylguanosine
  modified_base 19: mod_base = OTHER; note = 2'-O-methylguanosine
  modified_base 20: mod_base = OTHER; note = 2'-O-methylguanosine
  modified_base 21: mod_base = OTHER; note = 2'-O-methyladenosine
  modified_base 22: mod_base = OTHER; note = 2'-fluoroadenosine
  modified_base 23: mod_base = OTHER; note = 2'-fluoroadenosine
  modified_base 24: mod_base = OTHER; note = 2'-fluoroguanosine
  modified_base 25: mod_base = OTHER; note = 2'-O-methyladenosine
  modified_base 26: mod_base = OTHER; note = 2'-O-methylcytidine
  modified_base 27: mod_base = OTHER; note = 2'-O-methyladenosine
  modified_base 28: mod_base = OTHER; note = 2'-O-methyladenosine
  modified_base 29: mod_base = OTHER; note = 2'-O-methyluridine
  modified_base 30: mod_base = OTHER; note = 2'-O-methylguanosine
  modified_base 31: mod_base = OTHER; note = 2'-O-methyladenosine
  modified_base 32: mod_base = OTHER; note = 2'-O-methylguanosine
  modified_base 33: mod_base = OTHER; note = 2'-O-methylcytidine
  modified_base 34: mod_base = OTHER; note = 2'-O-methyladenosine

SEQ ID NO: 809 - RNA, 34 nt, synthetic construct; identical to SEQ ID NO: 557
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyluridine
  modified_base 8: mod_base = OTHER; note = 2'-O-methyluridine
  modified_base 9: mod_base = OTHER; note = 2'-O-methylcytidine
  modified_base 10: mod_base = OTHER; note = 2'-O-methyladenosine
  modified_base 11: mod_base = OTHER; note = 2'-O-methylguanosine
  modified_base 12: mod_base = OTHER; note = 2'-O-methylguanosine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyluridine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methylcytidine
  modified_base 19: mod_base = OTHER; note = 2'-O-methyluridine
  modified_base 20: mod_base = OTHER; note = 2'-O-methyladenosine
  modified_base 21: mod_base = OTHER; note = 2'-O-methyluridine
  modified_base 22: mod_base = OTHER; note = 2'-fluorouridine
  modified_base 23: mod_base = OTHER; note = 2'-fluorocytidine
  modified_base 24: mod_base = OTHER; note = 2'-fluorocytidine
  modified_base 25: mod_base = OTHER; note = 2'-O-methyluridine
  modified_base 26: mod_base = OTHER; note = 2'-O-methylguanosine
  modified_base 27: mod_base = OTHER; note = 2'-O-methyladenosine
  modified_base 28: mod_base = OTHER; note = 2'-O-methyladenosine
  modified_base 29: mod_base = OTHER; note = 2'-O-methyluridine
  modified_base 30: mod_base = OTHER; note = 2'-O-methyluridine
  modified_base 31: mod_base = OTHER; note = 2'-O-methyluridine
  modified_base 32: mod_base = OTHER; note = 2'-O-methyluridine
  modified_base 33: mod_base = OTHER; note = 2'-O-methyladenosine
  modified_base 34: mod_base = OTHER; note = 2'-O-methyladenosine

SEQ ID NO: 810 - RNA, 34 nt, synthetic construct; identical to SEQ ID NO: 558
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-O-methylguanosine
  modified_base 5: mod_base = OTHER; note = 2'-O-methyladenosine
  modified_base 6: mod_base = OTHER; note = 2'-O-methyluridine
  modified_base 7: mod_base = OTHER; note = 2'-O-methylcytidine
  modified_base 8: mod_base = OTHER; note = 2'-O-methyluridine
  modified_base 9: mod_base = OTHER; note = 2'-O-methyluridine
  modified_base 10: mod_base = OTHER; note = 2'-O-methylguanosine
  modified_base 11: mod_base = OTHER; note = 2'-O-methylguanosine
  modified_base 12: mod_base = OTHER; note = 2'-O-methylcytidine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methylcytidine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methyluridine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluoroguanosine
  modified_base 24: mod_base = OTHER; note = 2'-fluorocytidine
  modified_base 25: mod_base = OTHER; note = 2'-O-methylcytidine
  modified_base 26: mod_base = OTHER; note = 2'-O-methyladenosine
  modified_base 27: mod_base = OTHER; note = 2'-O-methyladenosine
  modified_base 28: mod_base = OTHER; note = 2'-O-methylguanosine
  modified_base 29: mod_base = OTHER; note = 2'-O-methyladenosine
  modified_base 30: mod_base = OTHER; note = 2'-O-methyluridine
  modified_base 31: mod_base = OTHER; note = 2'-O-methylcytidine
  modified_base 32: mod_base = OTHER; note = 2'-O-methyluridine
  modified_base 33: mod_base = OTHER; note = 2'-O-methylcytidine
  modified_base 34: mod_base = OTHER; note = 2'-O-methyladenosine

SEQ ID NO: 811 - RNA, 34 nt, synthetic construct; identical to SEQ ID NO: 559
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-O-methylguanosine
  modified_base 5: mod_base = OTHER; note = 2'-O-methylcytidine
  modified_base 6: mod_base = OTHER; note = 2'-O-methyladenosine
  modified_base 7: mod_base = OTHER; note = 2'-O-methyluridine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methylcytidine
  modified_base 11: mod_base = OTHER; note = 2'-O-methyluridine
  modified_base 12: mod_base = OTHER; note = 2'-O-methylcytidine
  modified_base 13: mod_base = OTHER; note = 2'-O-methyluridine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-O-methylcytidine
  modified_base 17: mod_base = OTHER; note = 2'-O-methyladenosine
  modified_base 18: mod_base = OTHER; note = 2'-O-methylguanosine
  modified_base 19: mod_base = OTHER; note = 2'-O-methylcytidine
  modified_base 20: mod_base = OTHER; note = 2'-O-methyluridine
  modified_base 21: mod_base = OTHER; note = 2'-O-methylguanosine
  modified_base 22: mod_base = OTHER; note = 2'-fluoroadenosine
  modified_base 23: mod_base = OTHER; note = 2'-fluoroguanosine
  modified_base 24: mod_base = OTHER; note = 2'-fluoroadenosine
  modified_base 25: mod_base = OTHER; note = 2'-O-methylguanosine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methyladenosine
  modified_base 29: mod_base = OTHER; note = 2'-O-methyluridine
  modified_base 30: mod_base = OTHER; note = 2'-O-methylguanosine
  modified_base 31: mod_base = OTHER; note = 2'-O-methylcytidine
  modified_base 32: mod_base = OTHER; note = 2'-O-methyluridine
  modified_base 33: mod_base = OTHER; note = 2'-O-methylcytidine
  modified_base 34: mod_base = OTHER; note = 2'-O-methyladenosine

SEQ ID NO: 812 - RNA, 34 nt, synthetic construct; identical to SEQ ID NO: 560
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-O-methylcytidine
  modified_base 5: mod_base = OTHER; note = 2'-O-methylcytidine
  modified_base 6: mod_base = OTHER; note = 2'-O-methylguanosine
  modified_base 7: mod_base = OTHER; note = 2'-O-methyluridine
  modified_base 8: mod_base = OTHER; note = 2'-O-methylcytidine
  modified_base 9: mod_base = OTHER; note = 2'-O-methyladenosine
  modified_base 10: mod_base = OTHER; note = 2'-O-methyluridine
  modified_base 11: mod_base = OTHER; note = 2'-O-methyladenosine
  modified_base 12: mod_base = OTHER; note = 2'-O-methylguanosine
  modified_base 13: mod_base = OTHER; note = 2'-O-methylcytidine
  modified_base 14: mod_base = OTHER; note = 2'-fluoroadenosine
  modified_base 15: mod_base = OTHER; note = 2'-O-methylguanosine
  modified_base 16: mod_base = OTHER; note = 2'-O-methyluridine
  modified_base 17: mod_base = OTHER; note = 2'-O-methylguanosine
  modified_base 18: mod_base = OTHER; note = 2'-O-methylguanosine
  modified_base 19: mod_base = OTHER; note = 2'-O-methyladenosine
  modified_base 20: mod_base = OTHER; note = 2'-O-methylcytidine
  modified_base 21: mod_base = OTHER; note = 2'-O-methyluridine
  modified_base 22: mod_base = OTHER; note = 2'-fluoroguanosine
  modified_base 23: mod_base = OTHER; note = 2'-fluorocytidine
  modified_base 24: mod_base = OTHER; note = 2'-fluorouridine
  modified_base 25: mod_base = OTHER; note = 2'-O-methyladenosine
  modified_base 26: mod_base = OTHER; note = 2'-O-methyluridine
  modified_base 27: mod_base = OTHER; note = 2'-O-methylguanosine
  modified_base 28: mod_base = OTHER; note = 2'-O-methyladenosine
  modified_base 29: mod_base = OTHER; note = 2'-O-methylcytidine
  modified_base 30: mod_base = OTHER; note = 2'-O-methylguanosine
  modified_base 31: mod_base = OTHER; note = 2'-O-methylguanosine
  modified_base 32: mod_base = OTHER; note = 2'-O-methyluridine
  modified_base 33: mod_base = OTHER; note = 2'-O-methyluridine
  modified_base 34: mod_base = OTHER; note = 2'-O-methyladenosine

SEQ ID NO: 813 - RNA, 34 nt, synthetic construct; identical to SEQ ID NO: 561
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylguanosine
  modified_base 4: mod_base = OTHER; note = 2'-O-methyladenosine
  modified_base 5: mod_base = OTHER; note = 2'-O-methylguanosine
  modified_base 6: mod_base = OTHER; note = 2'-O-methylcytidine
  modified_base 7: mod_base = OTHER; note = 2'-O-methyluridine
  modified_base 8: mod_base = OTHER; note = 2'-O-methyluridine
  modified_base 9: mod_base = OTHER; note = 2'-O-methyluridine
  modified_base 10: mod_base = OTHER; note = 2'-O-methylguanosine
  modified_base 11: mod_base = OTHER; note = 2'-O-methyladenosine
  modified_base 12: mod_base = OTHER; note = 2'-O-methyluridine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methylcytidine
  modified_base 16: mod_base = OTHER; note = 2'-O-methylcytidine
  modified_base 17: mod_base = OTHER; note = 2'-O-methyluridine
  modified_base 18: mod_base = OTHER; note = 2'-O-methylguanosine
  modified_base 19: mod_base = OTHER; note = 2'-O-methyluridine
  modified_base 20: mod_base = OTHER; note = 2'-O-methylguanosine
  modified_base 21: mod_base = OTHER; note = 2'-O-methyladenosine
  modified_base 22: mod_base = OTHER; note = 2'-fluorouridine
  modified_base 23: mod_base = OTHER; note = 2'-fluoroadenosine
  modified_base 24: mod_base = OTHER; note = 2'-fluorouridine
  modified_base 25: mod_base = OTHER; note = 2'-O-methylcytidine
  modified_base 26: mod_base = OTHER; note = 2'-O-methyladenosine
  modified_base 27: mod_base = OTHER; note = 2'-O-methyladenosine
  modified_base 28: mod_base = OTHER; note = 2'-O-methyladenosine
  modified_base 29: mod_base = OTHER; note = 2'-O-methylguanosine
  modified_base 30: mod_base = OTHER; note = 2'-O-methylcytidine
  modified_base 31: mod_base = OTHER; note = 2'-O-methyluridine
  modified_base 32: mod_base = OTHER; note = 2'-O-methylcytidine
  modified_base 33: mod_base = OTHER; note = 2'-O-methyluridine
  modified_base 34: mod_base = OTHER; note = 2'-O-methyladenosine

SEQ ID NO: 814 - RNA, 34 nt, synthetic construct; identical to SEQ ID NO: 562
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylcytidine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyluridine
  modified_base 7: mod_base = OTHER; note = 2'-O-methylguanosine
  modified_base 8: mod_base = OTHER; note = 2'-O-methyluridine
  modified_base 9: mod_base = OTHER; note = 2'-O-methylguanosine
  modified_base 10: mod_base = OTHER; note = 2'-O-methylcytidine
  modified_base 11: mod_base = OTHER; note = 2'-O-methyluridine
  modified_base 12: mod_base = OTHER; note = 2'-O-methylguanosine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methylguanosine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluorocytidine
  modified_base 24: mod_base = OTHER; note = 2'-fluoroadenosine
  modified_base 25: mod_base = OTHER; note = 2'-O-methylguanosine
  modified_base 26: mod_base = OTHER; note = 2'-O-methylcytidine
  modified_base 27: mod_base = OTHER; note = 2'-O-methyladenosine
  modified_base 28: mod_base = OTHER; note = 2'-O-methylcytidine
  modified_base 29: mod_base = OTHER; note = 2'-O-methyladenosine
  modified_base 30: mod_base = OTHER; note = 2'-O-methyluridine
  modified_base 31: mod_base = OTHER; note = 2'-O-methyluridine
  modified_base 32: mod_base = OTHER; note = 2'-O-methylguanosine
  modified_base 33: mod_base = OTHER; note = 2'-O-methyluridine
  modified_base 34: mod_base = OTHER; note = 2'-O-methyladenosine

SEQ ID NO: 815 - RNA, 34 nt, synthetic construct; identical to SEQ ID NO: 563
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methylguanosine
  modified_base 4: mod_base = OTHER; note = 2'-O-methyluridine
  modified_base 5: mod_base = OTHER; note = 2'-O-methyladenosine
  modified_base 6: mod_base = OTHER; note = 2'-O-methylcytidine
  modified_base 7: mod_base = OTHER; note = 2'-O-methylguanosine
  modified_base 8: mod_base = OTHER; note = 2'-O-methylguanosine
  modified_base 9: mod_base = OTHER; note = 2'-O-methylguanosine
  modified_base 10: mod_base = OTHER; note = 2'-O-methyluridine
  modified_base 11: mod_base = OTHER; note = 2'-O-methyladenosine
  modified_base 12: mod_base = OTHER; note = 2'-O-methylguanosine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methylguanosine
  modified_base 16: mod_base = OTHER; note = 2'-O-methylcytidine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methylguanosine
  modified_base 20: mod_base = OTHER; note = 2'-O-methylcytidine
  modified_base 21: mod_base = OTHER; note = 2'-O-methyluridine
  modified_base 22: mod_base = OTHER; note = 2'-fluorouridine
  modified_base 23: mod_base = OTHER; note = 2'-fluorocytidine
  modified_base 24: mod_base = OTHER; note = 2'-fluorouridine
  modified_base 25: mod_base = OTHER; note = 2'-O-methyladenosine
  modified_base 26: mod_base = OTHER; note = 2'-O-methylcytidine
  modified_base 27: mod_base = OTHER; note = 2'-O-methylcytidine
  modified_base 28: mod_base = OTHER; note = 2'-O-methylcytidine
  modified_base 29: mod_base = OTHER; note = 2'-O-methylguanosine
  modified_base 30: mod_base = OTHER; note = 2'-O-methyluridine
  modified_base 31: mod_base = OTHER; note = 2'-O-methyladenosine
  modified_base 32: mod_base = OTHER; note = 2'-O-methylcytidine
  modified_base 33: mod_base = OTHER; note = 2'-O-methylcytidine
  modified_base 34: mod_base = OTHER; note = 2'-O-methyladenosine

SEQ ID NO: 816 - RNA, 34 nt, synthetic construct; identical to SEQ ID NO: 564
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methylguanosine
  modified_base 5: mod_base = OTHER; note = 2'-O-methyladenosine
  modified_base 6: mod_base = OTHER; note = 2'-O-methylcytidine
  modified_base 7: mod_base = OTHER; note = 2'-O-methylcytidine
  modified_base 8: mod_base = OTHER; note = 2'-O-methyluridine
  modified_base 9: mod_base = OTHER; note = 2'-O-methyladenosine
  modified_base 10: mod_base = OTHER; note = 2'-O-methylguanosine
  modified_base 11: mod_base = OTHER; note = 2'-O-methyladenosine
  modified_base 12: mod_base = OTHER; note = 2'-O-methylcytidine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methylguanosine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methyladenosine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluoroguanosine
  modified_base 24: mod_base = OTHER; note = 2'-fluorouridine
  modified_base 25: mod_base = OTHER; note = 2'-O-methylcytidine
  modified_base 26: mod_base = OTHER; note = 2'-O-methyluridine
  modified_base 27: mod_base = OTHER; note = 2'-O-methyladenosine
  modified_base 28: mod_base = OTHER; note = 2'-O-methylguanosine
  modified_base 29: mod_base = OTHER; note = 2'-O-methylguanosine
  modified_base 30: mod_base = OTHER; note = 2'-O-methyluridine
  modified_base 31: mod_base = OTHER; note = 2'-O-methylcytidine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 817 - RNA, 34 nt, synthetic construct; identical to SEQ ID NO: 565
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methyluridine
  modified_base 4: mod_base = OTHER; note = 2'-O-methylcytidine
  modified_base 5: mod_base = OTHER; note = 2'-O-methyluridine
  modified_base 6: mod_base = OTHER; note = 2'-O-methylcytidine
  modified_base 7: mod_base = OTHER; note = 2'-O-methyluridine
  modified_base 8: mod_base = OTHER; note = 2'-O-methyluridine
  modified_base 9: mod_base = OTHER; note = 2'-O-methylguanosine
  modified_base 10: mod_base = OTHER; note = 2'-O-methyluridine
  modified_base 11: mod_base = OTHER; note = 2'-O-methylguanosine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyluridine
  modified_base 16: mod_base = OTHER; note = 2'-O-methyladenosine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methylguanosine
  modified_base 22: mod_base = OTHER; note = 2'-fluorouridine
  modified_base 23: mod_base = OTHER; note = 2'-fluorouridine
  modified_base 24: mod_base = OTHER; note = 2'-fluorocytidine
  modified_base 25: mod_base = OTHER; note = 2'-O-methyladenosine
  modified_base 26: mod_base = OTHER; note = 2'-O-methylcytidine
  modified_base 27: mod_base = OTHER; note = 2'-O-methyladenosine
  modified_base 28: mod_base = OTHER; note = 2'-O-methyladenosine
  modified_base 29: mod_base = OTHER; note = 2'-O-methylguanosine
  modified_base 30: mod_base = OTHER; note = 2'-O-methyladenosine
  modified_base 31: mod_base = OTHER; note = 2'-O-methylguanosine
  modified_base 32: mod_base = OTHER; note = 2'-O-methyladenosine
  modified_base 33: mod_base = OTHER; note = 2'-O-methyladenosine
  modified_base 34: mod_base = OTHER; note = 2'-O-methyladenosine

SEQ ID NO: 818 - RNA, 34 nt, synthetic construct; identical to SEQ ID NO: 566
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methyluridine
  modified_base 4: mod_base = OTHER; note = 2'-O-methylcytidine
  modified_base 5: mod_base = OTHER; note = 2'-O-methyladenosine
  modified_base 6: mod_base = OTHER; note = 2'-O-methylguanosine
  modified_base 7: mod_base = OTHER; note = 2'-O-methylguanosine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyluridine
  modified_base 11: mod_base = OTHER; note = 2'-O-methyluridine
  modified_base 12: mod_base = OTHER; note = 2'-O-methylcytidine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methylcytidine
  modified_base 17: mod_base = OTHER; note = 2'-O-methyluridine
  modified_base 18: mod_base = OTHER; note = 2'-O-methyluridine
  modified_base 19: mod_base = OTHER; note = 2'-O-methylcytidine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluoroguanosine
  modified_base 24: mod_base = OTHER; note = 2'-fluoroadenosine
  modified_base 25: mod_base = OTHER; note = 2'-O-methyladenosine
  modified_base 26: mod_base = OTHER; note = 2'-O-methyluridine
  modified_base 27: mod_base = OTHER; note = 2'-O-methyluridine
  modified_base 28: mod_base = OTHER; note = 2'-O-methylcytidine
  modified_base 29: mod_base = OTHER; note = 2'-O-methylcytidine
  modified_base 30: mod_base = OTHER; note = 2'-O-methyluridine
  modified_base 31: mod_base = OTHER; note = 2'-O-methylguanosine
  modified_base 32: mod_base = OTHER; note = 2'-O-methyladenosine
  modified_base 33: mod_base = OTHER; note = 2'-O-methyladenosine
  modified_base 34: mod_base = OTHER; note = 2'-O-methyladenosine

SEQ ID NO: 819 - RNA, 34 nt, synthetic construct; identical to SEQ ID NO: 567
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methylcytidine
  modified_base 4: mod_base = OTHER; note = 2'-O-methyladenosine
  modified_base 5: mod_base = OTHER; note = 2'-O-methylguanosine
  modified_base 6: mod_base = OTHER; note = 2'-O-methylguanosine
  modified_base 7: mod_base = OTHER; note = 2'-O-methyluridine
  modified_base 8: mod_base = OTHER; note = 2'-O-methyluridine
  modified_base 9: mod_base = OTHER; note = 2'-O-methyluridine
  modified_base 10: mod_base = OTHER; note = 2'-O-methyluridine
  modified_base 11: mod_base = OTHER; note = 2'-O-methylcytidine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methylcytidine
  modified_base 19: mod_base = OTHER; note = 2'-O-methyluridine
  modified_base 20: mod_base = OTHER; note = 2'-O-methyluridine
  modified_base 21: mod_base = OTHER; note = 2'-O-methyladenosine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluoroguanosine
  modified_base 25: mod_base = OTHER; note = 2'-O-methyladenosine
  modified_base 26: mod_base = OTHER; note = 2'-O-methyladenosine
  modified_base 27: mod_base = OTHER; note = 2'-O-methyladenosine
  modified_base 28: mod_base = OTHER; note = 2'-O-methyladenosine
  modified_base 29: mod_base = OTHER; note = 2'-O-methylcytidine
  modified_base 30: mod_base = OTHER; note = 2'-O-methylcytidine
  modified_base 31: mod_base = OTHER; note = 2'-O-methyluridine
  modified_base 32: mod_base = OTHER; note = 2'-O-methylguanosine
  modified_base 33: mod_base = OTHER; note = 2'-O-methylguanosine
  modified_base 34: mod_base = OTHER; note = 2'-O-methyladenosine

SEQ ID NO: 820 - RNA, 34 nt, synthetic construct; identical to SEQ ID NO: 568
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methylcytidine
  modified_base 6: mod_base = OTHER; note = 2'-O-methyluridine
  modified_base 7: mod_base = OTHER; note = 2'-O-methyluridine
  modified_base 8: mod_base = OTHER; note = 2'-O-methylguanosine
  modified_base 9: mod_base = OTHER; note = 2'-O-methyladenosine
  modified_base 10: mod_base = OTHER; note = 2'-O-methyladenosine
  modified_base 11: mod_base = OTHER; note = 2'-O-methyluridine
  modified_base 12: mod_base = OTHER; note = 2'-O-methylguanosine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-O-methylcytidine
  modified_base 17: mod_base = OTHER; note = 2'-O-methylguanosine
  modified_base 18: mod_base = OTHER; note = 2'-O-methyladenosine
  modified_base 19: mod_base = OTHER; note = 2'-O-methylcytidine
  modified_base 20: mod_base = OTHER; note = 2'-O-methyluridine
  modified_base 21: mod_base = OTHER; note = 2'-O-methyluridine
  modified_base 22: mod_base = OTHER; note = 2'-fluorouridine
  modified_base 23: mod_base = OTHER; note = 2'-fluorocytidine
  modified_base 24: mod_base = OTHER; note = 2'-fluoroadenosine
  modified_base 25: mod_base = OTHER; note = 2'-O-methyluridine
  modified_base 26: mod_base = OTHER; note = 2'-O-methyluridine
  modified_base 27: mod_base = OTHER; note = 2'-O-methylcytidine
  modified_base 28: mod_base = OTHER; note = 2'-O-methyladenosine
  modified_base 29: mod_base = OTHER; note = 2'-O-methyladenosine
  modified_base 30: mod_base = OTHER; note = 2'-O-methylguanosine
  modified_base 31: mod_base = OTHER; note = 2'-O-methyluridine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 821 - RNA, 34 nt, synthetic construct; identical to SEQ ID NO: 569
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methyluridine
  modified_base 4: mod_base = OTHER; note = 2'-O-methylguanosine
  modified_base 5: mod_base = OTHER; note = 2'-O-methylcytidine
  modified_base 6: mod_base = OTHER; note = 2'-O-methyluridine
  modified_base 7: mod_base = OTHER; note = 2'-O-methylguanosine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methylguanosine
  modified_base 11: mod_base = OTHER; note = 2'-O-methyluridine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluoroguanosine
  modified_base 15: mod_base = OTHER; note = 2'-O-methylcytidine
  modified_base 16: mod_base = OTHER; note = 2'-O-methyladenosine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methyladenosine
  modified_base 20: mod_base = OTHER; note = 2'-O-methylguanosine
  modified_base 21: mod_base = OTHER; note = 2'-O-methylcytidine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluoroadenosine
  modified_base 25: mod_base = OTHER; note = 2'-O-methylcytidine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methylcytidine
  modified_base 29: mod_base = OTHER; note = 2'-O-methyladenosine
  modified_base 30: mod_base = OTHER; note = 2'-O-methylguanosine
  modified_base 31: mod_base = OTHER; note = 2'-O-methylcytidine
  modified_base 32: mod_base = OTHER; note = 2'-O-methyladenosine
  modified_base 33: mod_base = OTHER; note = 2'-O-methylcytidine
  modified_base 34: mod_base = OTHER; note = 2'-O-methyladenosine

SEQ ID NO: 822 - RNA, 34 nt, synthetic construct; identical to SEQ ID NO: 570
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-O-methylcytidine
  modified_base 5: mod_base = OTHER; note = 2'-O-methylcytidine
  modified_base 6: mod_base = OTHER; note = 2'-O-methyluridine
  modified_base 7: mod_base = OTHER; note = 2'-O-methylcytidine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methyluridine
  modified_base 11: mod_base = OTHER; note = 2'-O-methylcytidine
  modified_base 12: mod_base = OTHER; note = 2'-O-methylcytidine
  modified_base 13: mod_base = OTHER; note = 2'-O-methylguanosine
  modified_base 14: mod_base = OTHER; note = 2'-fluoroadenosine
  modified_base 15: mod_base = OTHER; note = 2'-O-methylguanosine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methylguanosine
  modified_base 20: mod_base = OTHER; note = 2'-O-methylcytidine
  modified_base 21: mod_base = OTHER; note = 2'-O-methyluridine
  modified_base 22: mod_base = OTHER; note = 2'-fluorocytidine
  modified_base 23: mod_base = OTHER; note = 2'-fluoroguanosine
  modified_base 24: mod_base = OTHER; note = 2'-fluoroguanosine
  modified_base 25: mod_base = OTHER; note = 2'-O-methyladenosine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methylguanosine
  modified_base 29: mod_base = OTHER; note = 2'-O-methyladenosine
  modified_base 30: mod_base = OTHER; note = 2'-O-methylguanosine
  modified_base 31: mod_base = OTHER; note = 2'-O-methylguanosine
  modified_base 32: mod_base = OTHER; note = 2'-O-methyluridine
  modified_base 33: mod_base = OTHER; note = 2'-O-methylcytidine
  modified_base 34: mod_base = OTHER; note = 2'-O-methyladenosine

SEQ ID NO: 823 - RNA, 34 nt, synthetic construct; identical to SEQ ID NO: 571
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methyluridine
  modified_base 6: mod_base = OTHER; note = 2'-O-methyluridine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-O-methylguanosine
  modified_base 10: mod_base = OTHER; note = 2'-O-methyluridine
  modified_base 11: mod_base = OTHER; note = 2'-O-methyluridine
  modified_base 12: mod_base = OTHER; note = 2'-O-methylguanosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyluridine
  modified_base 16: mod_base = OTHER; note = 2'-O-methyladenosine
  modified_base 17: mod_base = OTHER; note = 2'-O-methylguanosine
  modified_base 18: mod_base = OTHER; note = 2'-O-methyladenosine
  modified_base 19: mod_base = OTHER; note = 2'-O-methylcytidine
  modified_base 20: mod_base = OTHER; note = 2'-O-methyladenosine
  modified_base 21: mod_base = OTHER; note = 2'-O-methylguanosine
  modified_base 22: mod_base = OTHER; note = 2'-fluorouridine
  modified_base 23: mod_base = OTHER; note = 2'-fluorocytidine
  modified_base 24: mod_base = OTHER; note = 2'-fluoroadenosine
  modified_base 25: mod_base = OTHER; note = 2'-O-methyladenosine
  modified_base 26: mod_base = OTHER; note = 2'-O-methylcytidine
  modified_base 27: mod_base = OTHER; note = 2'-O-methyluridine
  modified_base 28: mod_base = OTHER; note = 2'-O-methyluridine
  modified_base 29: mod_base = OTHER; note = 2'-O-methyladenosine
  modified_base 30: mod_base = OTHER; note = 2'-O-methyladenosine
  modified_base 31: mod_base = OTHER; note = 2'-O-methyluridine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 824 - RNA, 34 nt, synthetic construct; identical to SEQ ID NO: 572
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylguanosine
  modified_base 4: mod_base = OTHER; note = 2'-O-methyladenosine
  modified_base 5: mod_base = OTHER; note = 2'-O-methylcytidine
  modified_base 6: mod_base = OTHER; note = 2'-O-methyladenosine
  modified_base 7: mod_base = OTHER; note = 2'-O-methylcytidine
  modified_base 8: mod_base = OTHER; note = 2'-O-methylguanosine
  modified_base 9: mod_base = OTHER; note = 2'-O-methyluridine
  modified_base 10: mod_base = OTHER; note = 2'-O-methyluridine
  modified_base 11: mod_base = OTHER; note = 2'-O-methylcytidine
  modified_base 12: mod_base = OTHER; note = 2'-O-methylguanosine
  modified_base 13: mod_base = OTHER; note = 2'-O-methylcytidine
  modified_base 14: mod_base = OTHER; note = 2'-fluorocytidine
  modified_base 15: mod_base = OTHER; note = 2'-O-methylguanosine
  modified_base 16: mod_base = OTHER; note = 2'-O-methylcytidine
  modified_base 17: mod_base = OTHER; note = 2'-O-methyluridine
  modified_base 18: mod_base = OTHER; note = 2'-O-methylguanosine
  modified_base 19: mod_base = OTHER; note = 2'-O-methylguanosine
  modified_base 20: mod_base = OTHER; note = 2'-O-methylcytidine
  modified_base 21: mod_base = OTHER; note = 2'-O-methylguanosine
  modified_base 22: mod_base = OTHER; note = 2'-fluoroguanosine
  modified_base 23: mod_base = OTHER; note = 2'-fluorocytidine
  modified_base 24: mod_base = OTHER; note = 2'-fluoroguanosine
  modified_base 25: mod_base = OTHER; note = 2'-O-methyladenosine
  modified_base 26: mod_base = OTHER; note = 2'-O-methyladenosine
  modified_base 27: mod_base = OTHER; note = 2'-O-methylcytidine
  modified_base 28: mod_base = OTHER; note = 2'-O-methylguanosine
  modified_base 29: mod_base = OTHER; note = 2'-O-methyluridine
  modified_base 30: mod_base = OTHER; note = 2'-O-methylguanosine
  modified_base 31: mod_base = OTHER; note = 2'-O-methyluridine
  modified_base 32: mod_base = OTHER; note = 2'-O-methylcytidine
  modified_base 33: mod_base = OTHER; note = 2'-O-methyladenosine
  modified_base 34: mod_base = OTHER; note = 2'-O-methyladenosine

SEQ ID NO: 825 - RNA, 34 nt, synthetic construct; identical to SEQ ID NO: 573
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methyluridine
  modified_base 5: mod_base = OTHER; note = 2'-O-methyluridine
  modified_base 6: mod_base = OTHER; note = 2'-O-methylguanosine
  modified_base 7: mod_base = OTHER; note = 2'-O-methyluridine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methyluridine
  modified_base 11: mod_base = OTHER; note = 2'-O-methyluridine
  modified_base 12: mod_base = OTHER; note = 2'-O-methylcytidine
  modified_base 13: mod_base = OTHER; note = 2'-O-methyluridine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methylguanosine
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methylguanosine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluoroadenosine
  modified_base 23: mod_base = OTHER; note = 2'-fluoroguanosine
  modified_base 24: mod_base = OTHER; note = 2'-fluoroadenosine
  modified_base 25: mod_base = OTHER; note = 2'-O-methyladenosine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methyladenosine
  modified_base 29: mod_base = OTHER; note = 2'-O-methylcytidine
  modified_base 30: mod_base = OTHER; note = 2'-O-methyladenosine
  modified_base 31: mod_base = OTHER; note = 2'-O-methyladenosine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 826 - RNA, 34 nt, synthetic construct; identical to SEQ ID NO: 574
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methylcytidine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methylcytidine
  modified_base 7: mod_base = OTHER; note = 2'-O-methyluridine
  modified_base 8: mod_base = OTHER; note = 2'-O-methyluridine
  modified_base 9: mod_base = OTHER; note = 2'-O-methylguanosine
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-O-methyluridine
  modified_base 13: mod_base = OTHER; note = 2'-O-methylguanosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methylcytidine
  modified_base 18: mod_base = OTHER; note = 2'-O-methylguanosine
  modified_base 19: mod_base = OTHER; note = 2'-O-methyladenosine
  modified_base 20: mod_base = OTHER; note = 2'-O-methyluridine
  modified_base 21: mod_base = OTHER; note = 2'-O-methyluridine
  modified_base 22: mod_base = OTHER; note = 2'-fluorocytidine
  modified_base 23: mod_base = OTHER; note = 2'-fluoroadenosine
  modified_base 24: mod_base = OTHER; note = 2'-fluorouridine
  modified_base 25: mod_base = OTHER; note = 2'-O-methyluridine
  modified_base 26: mod_base = OTHER; note = 2'-O-methylcytidine
  modified_base 27: mod_base = OTHER; note = 2'-O-methyladenosine
  modified_base 28: mod_base = OTHER; note = 2'-O-methyladenosine
  modified_base 29: mod_base = OTHER; note = 2'-O-methylguanosine
  modified_base 30: mod_base = OTHER; note = 2'-O-methyluridine
  modified_base 31: mod_base = OTHER; note = 2'-O-methyluridine
  modified_base 32: mod_base = OTHER; note = 2'-O-methylguanosine
  modified_base 33: mod_base = OTHER; note = 2'-O-methylguanosine
  modified_base 34: mod_base = OTHER; note = 2'-O-methyladenosine

SEQ ID NO: 827 - RNA, 34 nt, synthetic construct; identical to SEQ ID NO: 575
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methylcytidine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methylguanosine
  modified_base 9: mod_base = OTHER; note = 2'-O-methyluridine
  modified_base 10: mod_base = OTHER; note = 2'-O-methyladenosine
  modified_base 11: mod_base = OTHER; note = 2'-O-methylcytidine
  modified_base 12: mod_base = OTHER; note = 2'-O-methyluridine
  modified_base 13: mod_base = OTHER; note = 2'-O-methylcytidine
  modified_base 14: mod_base = OTHER; note = 2'-fluoroadenosine
  modified_base 15: mod_base = OTHER; note = 2'-O-methylguanosine
  modified_base 16: mod_base = OTHER; note = 2'-O-methyladenosine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methylcytidine
  modified_base 20: mod_base = OTHER; note = 2'-O-methylcytidine
  modified_base 21: mod_base = OTHER; note = 2'-O-methyluridine
  modified_base 22: mod_base = OTHER; note = 2'-fluoroguanosine
  modified_base 23: mod_base = OTHER; note = 2'-fluoroadenosine
  modified_base 24: mod_base = OTHER; note = 2'-fluoroguanosine
  modified_base 25: mod_base = OTHER; note = 2'-O-methyluridine
  modified_base 26: mod_base = OTHER; note = 2'-O-methyladenosine
  modified_base 27: mod_base = OTHER; note = 2'-O-methylcytidine
  modified_base 28: mod_base = OTHER; note = 2'-O-methyluridine
  modified_base 29: mod_base = OTHER; note = 2'-O-methyluridine
  modified_base 30: mod_base = OTHER; note = 2'-O-methyluridine
  modified_base 31: mod_base = OTHER; note = 2'-O-methylguanosine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 828 - RNA, 34 nt, synthetic construct; identical to SEQ ID NO: 576
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylguanosine
  modified_base 4: mod_base = OTHER; note = 2'-O-methylcytidine
  modified_base 5: mod_base = OTHER; note = 2'-O-methyladenosine
  modified_base 6: mod_base = OTHER; note = 2'-O-methylguanosine
  modified_base 7: mod_base = OTHER; note = 2'-O-methyluridine
  modified_base 8: mod_base = OTHER; note = 2'-O-methylguanosine
  modified_base 9: mod_base = OTHER; note = 2'-O-methylguanosine
  modified_base 10: mod_base = OTHER; note = 2'-O-methyluridine
  modified_base 11: mod_base = OTHER; note = 2'-O-methyladenosine
  modified_base 12: mod_base = OTHER; note = 2'-O-methylguanosine
  modified_base 13: mod_base = OTHER; note = 2'-O-methylguanosine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methyladenosine
  modified_base 17: mod_base = OTHER; note = 2'-O-methylcytidine
  modified_base 18: mod_base = OTHER; note = 2'-O-methylguanosine
  modified_base 19: mod_base = OTHER; note = 2'-O-methylcytidine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluorocytidine
  modified_base 23: mod_base = OTHER; note = 2'-fluorocytidine
  modified_base 24: mod_base = OTHER; note = 2'-fluorouridine
  modified_base 25: mod_base = OTHER; note = 2'-O-methyladenosine
  modified_base 26: mod_base = OTHER; note = 2'-O-methylcytidine
  modified_base 27: mod_base = OTHER; note = 2'-O-methylcytidine
  modified_base 28: mod_base = OTHER; note = 2'-O-methyladenosine
  modified_base 29: mod_base = OTHER; note = 2'-O-methylcytidine
  modified_base 30: mod_base = OTHER; note = 2'-O-methyluridine
  modified_base 31: mod_base = OTHER; note = 2'-O-methylguanosine
  modified_base 32: mod_base = OTHER; note = 2'-O-methylcytidine
  modified_base 33: mod_base = OTHER; note = 2'-O-methyladenosine
  modified_base 34: mod_base = OTHER; note = 2'-O-methyladenosine

SEQ ID NO: 829 - RNA, 34 nt, synthetic construct; identical to SEQ ID NO: 577
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylcytidine
  modified_base 4: mod_base = OTHER; note = 2'-O-methyladenosine
  modified_base 5: mod_base = OTHER; note = 2'-O-methyluridine
  modified_base 6: mod_base = OTHER; note = 2'-O-methylguanosine
  modified_base 7: mod_base = OTHER; note = 2'-O-methyladenosine
  modified_base 8: mod_base = OTHER; note = 2'-O-methylguanosine
  modified_base 9: mod_base = OTHER; note = 2'-O-methylguanosine
  modified_base 10: mod_base = OTHER; note = 2'-O-methyladenosine
  modified_base 11: mod_base = OTHER; note = 2'-O-methyluridine
  modified_base 12: mod_base = OTHER; note = 2'-O-methylguanosine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methyladenosine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methyluridine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluorouridine
  modified_base 23: mod_base = OTHER; note = 2'-fluorocytidine
  modified_base 24: mod_base = OTHER; note = 2'-fluoroadenosine
  modified_base 25: mod_base = OTHER; note = 2'-O-methyluridine
  modified_base 26: mod_base = OTHER; note = 2'-O-methylcytidine
  modified_base 27: mod_base = OTHER; note = 2'-O-methylcytidine
  modified_base 28: mod_base = OTHER; note = 2'-O-methyluridine
  modified_base 29: mod_base = OTHER; note = 2'-O-methylcytidine
  modified_base 30: mod_base = OTHER; note = 2'-O-methyladenosine
  modified_base 31: mod_base = OTHER; note = 2'-O-methyluridine
  modified_base 32: mod_base = OTHER; note = 2'-O-methylguanosine
  modified_base 33: mod_base = OTHER; note = 2'-O-methyladenosine
  modified_base 34: mod_base = OTHER; note = 2'-O-methyladenosine

SEQ ID NO: 830 - RNA, 34 nt, synthetic construct; identical to SEQ ID NO: 578
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methyluridine
  modified_base 4: mod_base = OTHER; note = 2'-O-methylcytidine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methylcytidine
  modified_base 8: mod_base = OTHER; note = 2'-O-methyluridine
  modified_base 9: mod_base = OTHER; note = 2'-O-methyluridine
  modified_base 10: mod_base = OTHER; note = 2'-O-methylguanosine
  modified_base 11: mod_base = OTHER; note = 2'-O-methyluridine
  modified_base 12: mod_base = OTHER; note = 2'-O-methylguanosine
  modified_base 13: mod_base = OTHER; note = 2'-O-methylguanosine
  modified_base 14: mod_base = OTHER; note = 2'-fluorouridine
  modified_base 15: mod_base = OTHER; note = 2'-O-methylcytidine
  modified_base 16: mod_base = OTHER; note = 2'-O-methyluridine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methyladenosine
  modified_base 20: mod_base = OTHER; note = 2'-O-methylguanosine
  modified_base 21: mod_base = OTHER; note = 2'-O-methyladenosine
  modified_base 22: mod_base = OTHER; note = 2'-fluorocytidine
  modified_base 23: mod_base = OTHER; note = 2'-fluorocytidine
  modified_base 24: mod_base = OTHER; note = 2'-fluoroadenosine
  modified_base 25: mod_base = OTHER; note = 2'-O-methylcytidine
  modified_base 26: mod_base = OTHER; note = 2'-O-methyladenosine
  modified_base 27: mod_base = OTHER; note = 2'-O-methyladenosine
  modified_base 28: mod_base = OTHER; note = 2'-O-methylguanosine
  modified_base 29: mod_base = OTHER; note = 2'-O-methyluridine
  modified_base 30: mod_base = OTHER; note = 2'-O-methyluridine
  modified_base 31: mod_base = OTHER; note = 2'-O-methylguanosine
  modified_base 32: mod_base = OTHER; note = 2'-O-methyladenosine
  modified_base 33: mod_base = OTHER; note = 2'-O-methyladenosine
  modified_base 34: mod_base = OTHER; note = 2'-O-methyladenosine

SEQ ID NO: 831 - RNA, 34 nt, synthetic construct; identical to SEQ ID NO: 579
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methyluridine
  modified_base 4: mod_base = OTHER; note = 2'-O-methyladenosine
  modified_base 5: mod_base = OTHER; note = 2'-O-methylguanosine
  modified_base 6: mod_base = OTHER; note = 2'-O-methyluridine
  modified_base 7: mod_base = OTHER; note = 2'-O-methyluridine
  modified_base 8: mod_base = OTHER; note = 2'-O-methylguanosine
  modified_base 9: mod_base = OTHER; note = 2'-O-methylguanosine
  modified_base 10: mod_base = OTHER; note = 2'-O-methyladenosine
  modified_base 11: mod_base = OTHER; note = 2'-O-methylguanosine
  modified_base 12: mod_base = OTHER; note = 2'-O-methylguanosine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methylguanosine
  modified_base 16: mod_base = OTHER; note = 2'-O-methylcytidine
  modified_base 17: mod_base = OTHER; note = 2'-O-methylcytidine
  modified_base 18: mod_base = OTHER; note = 2'-O-methyluridine
  modified_base 19: mod_base = OTHER; note = 2'-O-methylcytidine
  modified_base 20: mod_base = OTHER; note = 2'-O-methylcytidine
  modified_base 21: mod_base = OTHER; note = 2'-O-methyluridine
  modified_base 22: mod_base = OTHER; note = 2'-fluorouridine
  modified_base 23: mod_base = OTHER; note = 2'-fluorocytidine
  modified_base 24: mod_base = OTHER; note = 2'-fluorocytidine
  modified_base 25: mod_base = OTHER; note = 2'-O-methyluridine
  modified_base 26: mod_base = OTHER; note = 2'-O-methylcytidine
  modified_base 27: mod_base = OTHER; note = 2'-O-methylcytidine
  modified_base 28: mod_base = OTHER; note = 2'-O-methyladenosine
  modified_base 29: mod_base = OTHER; note = 2'-O-methyladenosine
  modified_base 30: mod_base = OTHER; note = 2'-O-methylcytidine
  modified_base 31: mod_base = OTHER; note = 2'-O-methyluridine
  modified_base 32: mod_base = OTHER; note = 2'-O-methyladenosine
  modified_base 33: mod_base = OTHER; note = 2'-O-methylcytidine
  modified_base 34: mod_base = OTHER; note = 2'-O-methyladenosine

SEQ ID NO: 832 - RNA, 34 nt, synthetic construct; identical to SEQ ID NO: 580
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methyluridine
  modified_base 5: mod_base = OTHER; note = 2'-O-methylguanosine
  modified_base 6: mod_base = OTHER; note = 2'-O-methylcytidine
  modified_base 7: mod_base = OTHER; note = 2'-O-methyluridine
  modified_base 8: mod_base = OTHER; note = 2'-O-methylguanosine
  modified_base 9: mod_base = OTHER; note = 2'-O-methyluridine
  modified_base 10: mod_base = OTHER; note = 2'-O-methyladenosine
  modified_base 11: mod_base = OTHER; note = 2'-O-methylcytidine
  modified_base 12: mod_base = OTHER; note = 2'-O-methyladenosine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methylcytidine
  modified_base 17: mod_base = OTHER; note = 2'-O-methylcytidine
  modified_base 18: mod_base = OTHER; note = 2'-O-methyluridine
  modified_base 19: mod_base = OTHER; note = 2'-O-methylguanosine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluorouridine
  modified_base 24: mod_base = OTHER; note = 2'-fluoroguanosine
  modified_base 25: mod_base = OTHER; note = 2'-O-methyluridine
  modified_base 26: mod_base = OTHER; note = 2'-O-methyladenosine
  modified_base 27: mod_base = OTHER; note = 2'-O-methylcytidine
  modified_base 28: mod_base = OTHER; note = 2'-O-methyladenosine
  modified_base 29: mod_base = OTHER; note = 2'-O-methylguanosine
  modified_base 30: mod_base = OTHER; note = 2'-O-methylcytidine
  modified_base 31: mod_base = OTHER; note = 2'-O-methyladenosine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 833 - RNA, 34 nt, synthetic construct; identical to SEQ ID NO: 581
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylguanosine
  modified_base 4: mod_base = OTHER; note = 2'-O-methyluridine
  modified_base 5: mod_base = OTHER; note = 2'-O-methylcytidine
  modified_base 6: mod_base = OTHER; note = 2'-O-methyluridine
  modified_base 7: mod_base = OTHER; note = 2'-O-methyluridine
  modified_base 8: mod_base = OTHER; note = 2'-O-methyluridine
  modified_base 9: mod_base = OTHER; note = 2'-O-methylcytidine
  modified_base 10: mod_base = OTHER; note = 2'-O-methyluridine
  modified_base 11: mod_base = OTHER; note = 2'-O-methyluridine
  modified_base 12: mod_base = OTHER; note = 2'-O-methylguanosine
  modified_base 13: mod_base = OTHER; note = 2'-O-methylguanosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-O-methylguanosine
  modified_base 17: mod_base = OTHER; note = 2'-O-methylcytidine
  modified_base 18: mod_base = OTHER; note = 2'-O-methylcytidine
  modified_base 19: mod_base = OTHER; note = 2'-O-methyladenosine
  modified_base 20: mod_base = OTHER; note = 2'-O-methyluridine
  modified_base 21: mod_base = OTHER; note = 2'-O-methyluridine
  modified_base 22: mod_base = OTHER; note = 2'-fluorocytidine
  modified_base 23: mod_base = OTHER; note = 2'-fluorocytidine
  modified_base 24: mod_base = OTHER; note = 2'-fluoroadenosine
  modified_base 25: mod_base = OTHER; note = 2'-O-methyladenosine
  modified_base 26: mod_base = OTHER; note = 2'-O-methylguanosine
  modified_base 27: mod_base = OTHER; note = 2'-O-methyladenosine
  modified_base 28: mod_base = OTHER; note = 2'-O-methyladenosine
  modified_base 29: mod_base = OTHER; note = 2'-O-methyladenosine
  modified_base 30: mod_base = OTHER; note = 2'-O-methylguanosine
  modified_base 31: mod_base = OTHER; note = 2'-O-methyladenosine
  modified_base 32: mod_base = OTHER; note = 2'-O-methylcytidine
  modified_base 33: mod_base = OTHER; note = 2'-O-methyladenosine
  modified_base 34: mod_base = OTHER; note = 2'-O-methyladenosine

SEQ ID NO: 834 - RNA, 34 nt, synthetic construct; identical to SEQ ID NO: 582
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methylguanosine
  modified_base 4: mod_base = OTHER; note = 2'-O-methyladenosine
  modified_base 5: mod_base = OTHER; note = 2'-O-methylcytidine
  modified_base 6: mod_base = OTHER; note = 2'-O-methyluridine
  modified_base 7: mod_base = OTHER; note = 2'-O-methylcytidine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methyluridine
  modified_base 11: mod_base = OTHER; note = 2'-O-methylcytidine
  modified_base 12: mod_base = OTHER; note = 2'-O-methyluridine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methylguanosine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methyluridine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluorouridine
  modified_base 23: mod_base = OTHER; note = 2'-fluoroadenosine
  modified_base 24: mod_base = OTHER; note = 2'-fluoroguanosine
  modified_base 25: mod_base = OTHER; note = 2'-O-methyladenosine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methylguanosine
  modified_base 29: mod_base = OTHER; note = 2'-O-methyladenosine
  modified_base 30: mod_base = OTHER; note = 2'-O-methylguanosine
  modified_base 31: mod_base = OTHER; note = 2'-O-methyluridine
  modified_base 32: mod_base = OTHER; note = 2'-O-methylcytidine
  modified_base 33: mod_base = OTHER; note = 2'-O-methylguanosine
  modified_base 34: mod_base = OTHER; note = 2'-O-methyladenosine

SEQ ID NO: 835 - RNA, 34 nt, synthetic construct; identical to SEQ ID NO: 583
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-O-methylcytidine
  modified_base 5: mod_base = OTHER; note = 2'-O-methyladenosine
  modified_base 6: mod_base = OTHER; note = 2'-O-methyluridine
  modified_base 7: mod_base = OTHER; note = 2'-O-methylcytidine
  modified_base 8: mod_base = OTHER; note = 2'-O-methylcytidine
  modified_base 9: mod_base = OTHER; note = 2'-O-methyladenosine
  modified_base 10: mod_base = OTHER; note = 2'-O-methylguanosine
  modified_base 11: mod_base = OTHER; note = 2'-O-methyladenosine
  modified_base 12: mod_base = OTHER; note = 2'-O-methyluridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyluridine
  modified_base 16: mod_base = OTHER; note = 2'-O-methylcytidine
  modified_base 17: mod_base = OTHER; note = 2'-O-methylcytidine
  modified_base 18: mod_base = OTHER; note = 2'-O-methyluridine
  modified_base 19: mod_base = OTHER; note = 2'-O-methylcytidine
  modified_base 20: mod_base = OTHER; note = 2'-O-methyladenosine
  modified_base 21: mod_base = OTHER; note = 2'-O-methyluridine
  modified_base 22: mod_base = OTHER; note = 2'-fluorouridine
  modified_base 23: mod_base = OTHER; note = 2'-fluoroadenosine
  modified_base 24: mod_base = OTHER; note = 2'-fluorouridine
  modified_base 25: mod_base = OTHER; note = 2'-O-methylcytidine
  modified_base 26: mod_base = OTHER; note = 2'-O-methyluridine
  modified_base 27: mod_base = OTHER; note = 2'-O-methylguanosine
  modified_base 28: mod_base = OTHER; note = 2'-O-methylguanosine
  modified_base 29: mod_base = OTHER; note = 2'-O-methyladenosine
  modified_base 30: mod_base = OTHER; note = 2'-O-methyluridine
  modified_base 31: mod_base = OTHER; note = 2'-O-methylguanosine
  modified_base 32: mod_base = OTHER; note = 2'-O-methyluridine
  modified_base 33: mod_base = OTHER; note = 2'-O-methylcytidine
  modified_base 34: mod_base = OTHER; note = 2'-O-methyladenosine

SEQ ID NO: 836 - RNA, 34 nt, synthetic construct; identical to SEQ ID NO: 584
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylguanosine
  modified_base 4: mod_base = OTHER; note = 2'-O-methyladenosine
  modified_base 5: mod_base = OTHER; note = 2'-O-methylguanosine
  modified_base 6: mod_base = OTHER; note = 2'-O-methyladenosine
  modified_base 7: mod_base = OTHER; note = 2'-O-methyluridine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methyluridine
  modified_base 11: mod_base = OTHER; note = 2'-O-methylguanosine
  modified_base 12: mod_base = OTHER; note = 2'-O-methylguanosine
  modified_base 13: mod_base = OTHER; note = 2'-O-methylcytidine
  modified_base 14: mod_base = OTHER; note = 2'-fluorocytidine
  modified_base 15: mod_base = OTHER; note = 2'-O-methyluridine
  modified_base 16: mod_base = OTHER; note = 2'-O-methylguanosine
  modified_base 17: mod_base = OTHER; note = 2'-O-methylcytidine
  modified_base 18: mod_base = OTHER; note = 2'-O-methylcytidine
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methylguanosine
  modified_base 22: mod_base = OTHER; note = 2'-fluoroguanosine
  modified_base 23: mod_base = OTHER; note = 2'-fluorocytidine
  modified_base 24: mod_base = OTHER; note = 2'-fluorocytidine
  modified_base 25: mod_base = OTHER; note = 2'-O-methyladenosine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methyladenosine
  modified_base 29: mod_base = OTHER; note = 2'-O-methyluridine
  modified_base 30: mod_base = OTHER; note = 2'-O-methylcytidine
  modified_base 31: mod_base = OTHER; note = 2'-O-methyluridine
  modified_base 32: mod_base = OTHER; note = 2'-O-methylcytidine
  modified_base 33: mod_base = OTHER; note = 2'-O-methyladenosine
  modified_base 34: mod_base = OTHER; note = 2'-O-methyladenosine

SEQ ID NO: 837 - RNA, 34 nt, synthetic construct; identical to SEQ ID NO: 585
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylcytidine
  modified_base 4: mod_base = OTHER; note = 2'-O-methylguanosine
  modified_base 5: mod_base = OTHER; note = 2'-O-methylcytidine
  modified_base 6: mod_base = OTHER; note = 2'-O-methyluridine
  modified_base 7: mod_base = OTHER; note = 2'-O-methylguanosine
  modified_base 8: mod_base = OTHER; note = 2'-O-methyluridine
  modified_base 9: mod_base = OTHER; note = 2'-O-methylcytidine
  modified_base 10: mod_base = OTHER; note = 2'-O-methyluridine
  modified_base 11: mod_base = OTHER; note = 2'-O-methyluridine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methylguanosine
  modified_base 16: mod_base = OTHER; note = 2'-O-methylguanosine
  modified_base 17: mod_base = OTHER; note = 2'-O-methylcytidine
  modified_base 18: mod_base = OTHER; note = 2'-O-methylguanosine
  modified_base 19: mod_base = OTHER; note = 2'-O-methylguanosine
  modified_base 20: mod_base = OTHER; note = 2'-O-methylcytidine
  modified_base 21: mod_base = OTHER; note = 2'-O-methyluridine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluoroadenosine
  modified_base 25: mod_base = OTHER; note = 2'-O-methyladenosine
  modified_base 26: mod_base = OTHER; note = 2'-O-methylguanosine
  modified_base 27: mod_base = OTHER; note = 2'-O-methyladenosine
  modified_base 28: mod_base = OTHER; note = 2'-O-methylcytidine
  modified_base 29: mod_base = OTHER; note = 2'-O-methyladenosine
  modified_base 30: mod_base = OTHER; note = 2'-O-methylguanosine
  modified_base 31: mod_base = OTHER; note = 2'-O-methylcytidine
  modified_base 32: mod_base = OTHER; note = 2'-O-methylguanosine
  modified_base 33: mod_base = OTHER; note = 2'-O-methyluridine
  modified_base 34: mod_base = OTHER; note = 2'-O-methyladenosine

SEQ ID NO: 838 - RNA, 34 nt, synthetic construct; identical to SEQ ID NO: 586
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylguanosine
  modified_base 4: mod_base = OTHER; note = 2'-O-methyladenosine
  modified_base 5: mod_base = OTHER; note = 2'-O-methylcytidine
  modified_base 6: mod_base = OTHER; note = 2'-O-methyladenosine
  modified_base 7: mod_base = OTHER; note = 2'-O-methylguanosine
  modified_base 8: mod_base = OTHER; note = 2'-O-methylguanosine
  modified_base 9: mod_base = OTHER; note = 2'-O-methyladenosine
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-O-methylguanosine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methyluridine
  modified_base 16: mod_base = OTHER; note = 2'-O-methylcytidine
  modified_base 17: mod_base = OTHER; note = 2'-O-methylguanosine
  modified_base 18: mod_base = OTHER; note = 2'-O-methylguanosine
  modified_base 19: mod_base = OTHER; note = 2'-O-methylcytidine
  modified_base 20: mod_base = OTHER; note = 2'-O-methyladenosine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluorocytidine
  modified_base 24: mod_base = OTHER; note = 2'-fluorouridine
  modified_base 25: mod_base = OTHER; note = 2'-O-methyluridine
  modified_base 26: mod_base = OTHER; note = 2'-O-methyluridine
  modified_base 27: mod_base = OTHER; note = 2'-O-methylcytidine
  modified_base 28: mod_base = OTHER; note = 2'-O-methylcytidine
  modified_base 29: mod_base = OTHER; note = 2'-O-methyluridine
  modified_base 30: mod_base = OTHER; note = 2'-O-methylguanosine
  modified_base 31: mod_base = OTHER; note = 2'-O-methyluridine
  modified_base 32: mod_base = OTHER; note = 2'-O-methylcytidine
  modified_base 33: mod_base = OTHER; note = 2'-O-methyluridine
  modified_base 34: mod_base = OTHER; note = 2'-O-methyladenosine

SEQ ID NO: 839 - RNA, 34 nt, synthetic construct; identical to SEQ ID NO: 587
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methyluridine
  modified_base 4: mod_base = OTHER; note = 2'-O-methylguanosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methylcytidine
  modified_base 8: mod_base = OTHER; note = 2'-O-methyladenosine
  modified_base 9: mod_base = OTHER; note = 2'-O-methylcytidine
  modified_base 10: mod_base = OTHER; note = 2'-O-methyladenosine
  modified_base 11: mod_base = OTHER; note = 2'-O-methyluridine
  modified_base 12: mod_base = OTHER; note = 2'-O-methylguanosine
  modified_base 13: mod_base = OTHER; note = 2'-O-methyluridine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methylcytidine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methyladenosine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluoroadenosine
  modified_base 23: mod_base = OTHER; note = 2'-fluorocytidine
  modified_base 24: mod_base = OTHER; note = 2'-fluoroadenosine
  modified_base 25: mod_base = OTHER; note = 2'-O-methyluridine
  modified_base 26: mod_base = OTHER; note = 2'-O-methylguanosine
  modified_base 27: mod_base = OTHER; note = 2'-O-methyluridine
  modified_base 28: mod_base = OTHER; note = 2'-O-methylguanosine
  modified_base 29: mod_base = OTHER; note = 2'-O-methyluridine
  modified_base 30: mod_base = OTHER; note = 2'-O-methyluridine
  modified_base 31: mod_base = OTHER; note = 2'-O-methylcytidine
  modified_base 32: mod_base = OTHER; note = 2'-O-methyladenosine
  modified_base 33: mod_base = OTHER; note = 2'-O-methyladenosine
  modified_base 34: mod_base = OTHER; note = 2'-O-methyladenosine

SEQ ID NO: 840 - RNA, 34 nt, synthetic construct; identical to SEQ ID NO: 588
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyluridine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyluridine
  modified_base 9: mod_base = OTHER; note = 2'-O-methyluridine
  modified_base 10: mod_base = OTHER; note = 2'-O-methylcytidine
  modified_base 11: mod_base = OTHER; note = 2'-O-methyladenosine
  modified_base 12: mod_base = OTHER; note = 2'-O-methylguanosine
  modified_base 13: mod_base = OTHER; note = 2'-O-methylguanosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-O-methyluridine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methylcytidine
  modified_base 20: mod_base = OTHER; note = 2'-O-methyluridine
  modified_base 21: mod_base = OTHER; note = 2'-O-methyluridine
  modified_base 22: mod_base = OTHER; note = 2'-fluorocytidine
  modified_base 23: mod_base = OTHER; note = 2'-fluorocytidine
  modified_base 24: mod_base = OTHER; note = 2'-fluorouridine
  modified_base 25: mod_base = OTHER; note = 2'-O-methylguanosine
  modified_base 26: mod_base = OTHER; note = 2'-O-methyladenosine
  modified_base 27: mod_base = OTHER; note = 2'-O-methyladenosine
  modified_base 28: mod_base = OTHER; note = 2'-O-methyluridine
  modified_base 29: mod_base = OTHER; note = 2'-O-methyluridine
  modified_base 30: mod_base = OTHER; note = 2'-O-methyluridine
  modified_base 31: mod_base = OTHER; note = 2'-O-methyluridine
  modified_base 32: mod_base = OTHER; note = 2'-O-methyladenosine
  modified_base 33: mod_base = OTHER; note = 2'-O-methyluridine
  modified_base 34: mod_base = OTHER; note = 2'-O-methyladenosine

SEQ ID NO: 841 - RNA, 34 nt, synthetic construct; identical to SEQ ID NO: 589
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methylcytidine
  modified_base 4: mod_base = OTHER; note = 2'-O-methylcytidine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyluridine
  modified_base 9: mod_base = OTHER; note = 2'-O-methylcytidine
  modified_base 10: mod_base = OTHER; note = 2'-O-methylcytidine
  modified_base 11: mod_base = OTHER; note = 2'-O-methyluridine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methylcytidine
  modified_base 16: mod_base = OTHER; note = 2'-O-methyluridine
  modified_base 17: mod_base = OTHER; note = 2'-O-methyluridine
  modified_base 18: mod_base = OTHER; note = 2'-O-methylguanosine
  modified_base 19: mod_base = OTHER; note = 2'-O-methylguanosine
  modified_base 20: mod_base = OTHER; note = 2'-O-methylguanosine
  modified_base 21: mod_base = OTHER; note = 2'-O-methyladenosine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluoroadenosine
  modified_base 25: mod_base = OTHER; note = 2'-O-methylguanosine
  modified_base 26: mod_base = OTHER; note = 2'-O-methylguanosine
  modified_base 27: mod_base = OTHER; note = 2'-O-methyladenosine
  modified_base 28: mod_base = OTHER; note = 2'-O-methyluridine
  modified_base 29: mod_base = OTHER; note = 2'-O-methyluridine
  modified_base 30: mod_base = OTHER; note = 2'-O-methyluridine
  modified_base 31: mod_base = OTHER; note = 2'-O-methylguanosine
  modified_base 32: mod_base = OTHER; note = 2'-O-methylguanosine
  modified_base 33: mod_base = OTHER; note = 2'-O-methylguanosine
  modified_base 34: mod_base = OTHER; note = 2'-O-methyladenosine

SEQ ID NO: 842 - RNA, 34 nt, synthetic construct; identical to SEQ ID NO: 590
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-O-methylguanosine
  modified_base 5: mod_base = OTHER; note = 2'-O-methyladenosine
  modified_base 6: mod_base = OTHER; note = 2'-O-methylguanosine
  modified_base 7: mod_base = OTHER; note = 2'-O-methyladenosine
  modified_base 8: mod_base = OTHER; note = 2'-O-methyluridine
  modified_base 9: mod_base = OTHER; note = 2'-O-methylcytidine
  modified_base 10: mod_base = OTHER; note = 2'-O-methyluridine
  modified_base 11: mod_base = OTHER; note = 2'-O-methylcytidine
  modified_base 12: mod_base = OTHER; note = 2'-O-methyladenosine
  modified_base 13: mod_base = OTHER; note = 2'-O-methyluridine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-O-methylcytidine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methyladenosine
  modified_base 20: mod_base = OTHER; note = 2'-O-methyluridine
  modified_base 21: mod_base = OTHER; note = 2'-O-methylguanosine
  modified_base 22: mod_base = OTHER; note = 2'-fluoroadenosine
  modified_base 23: mod_base = OTHER; note = 2'-fluorouridine
  modified_base 24: mod_base = OTHER; note = 2'-fluoroguanosine
  modified_base 25: mod_base = OTHER; note = 2'-O-methyladenosine
  modified_base 26: mod_base = OTHER; note = 2'-O-methylguanosine
  modified_base 27: mod_base = OTHER; note = 2'-O-methyladenosine
  modified_base 28: mod_base = OTHER; note = 2'-O-methyluridine
  modified_base 29: mod_base = OTHER; note = 2'-O-methylcytidine
  modified_base 30: mod_base = OTHER; note = 2'-O-methyluridine
  modified_base 31: mod_base = OTHER; note = 2'-O-methylcytidine
  modified_base 32: mod_base = OTHER; note = 2'-O-methyluridine
  modified_base 33: mod_base = OTHER; note = 2'-O-methyluridine
  modified_base 34: mod_base = OTHER; note = 2'-O-methyladenosine

SEQ ID NO: 843 - RNA, 34 nt, synthetic construct; identical to SEQ ID NO: 591
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methylguanosine
  modified_base 6: mod_base = OTHER; note = 2'-O-methylcytidine
  modified_base 7: mod_base = OTHER; note = 2'-O-methyladenosine
  modified_base 8: mod_base = OTHER; note = 2'-O-methyluridine
  modified_base 9: mod_base = OTHER; note = 2'-O-methyluridine
  modified_base 10: mod_base = OTHER; note = 2'-O-methylguanosine
  modified_base 11: mod_base = OTHER; note = 2'-O-methyladenosine
  modified_base 12: mod_base = OTHER; note = 2'-O-methyluridine
  modified_base 13: mod_base = OTHER; note = 2'-O-methylguanosine
  modified_base 14: mod_base = OTHER; note = 2'-fluorouridine
  modified_base 15: mod_base = OTHER; note = 2'-O-methyluridine
  modified_base 16: mod_base = OTHER; note = 2'-O-methylcytidine
  modified_base 17: mod_base = OTHER; note = 2'-O-methyladenosine
  modified_base 18: mod_base = OTHER; note = 2'-O-methylcytidine
  modified_base 19: mod_base = OTHER; note = 2'-O-methyluridine
  modified_base 20: mod_base = OTHER; note = 2'-O-methyladenosine
  modified_base 21: mod_base = OTHER; note = 2'-O-methyladenosine
  modified_base 22: mod_base = OTHER; note = 2'-fluorocytidine
  modified_base 23: mod_base = OTHER; note = 2'-fluoroadenosine
  modified_base 24: mod_base = OTHER; note = 2'-fluorouridine
  modified_base 25: mod_base = OTHER; note = 2'-O-methylcytidine
  modified_base 26: mod_base = OTHER; note = 2'-O-methyladenosine
  modified_base 27: mod_base = OTHER; note = 2'-O-methyladenosine
  modified_base 28: mod_base = OTHER; note = 2'-O-methyluridine
  modified_base 29: mod_base = OTHER; note = 2'-O-methylguanosine
  modified_base 30: mod_base = OTHER; note = 2'-O-methylcytidine
  modified_base 31: mod_base = OTHER; note = 2'-O-methyluridine
  modified_base 32: mod_base = OTHER; note = 2'-O-methyluridine
  modified_base 33: mod_base = OTHER; note = 2'-O-methyluridine
  modified_base 34: mod_base = OTHER; note = 2'-O-methyladenosine

SEQ ID NO: 844 - RNA, 34 nt, synthetic construct; identical to SEQ ID NO: 592
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylguanosine
  modified_base 4: mod_base = OTHER; note = 2'-O-methylguanosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyluridine
  modified_base 8: mod_base = OTHER; note = 2'-O-methyluridine
  modified_base 9: mod_base = OTHER; note = 2'-O-methylcytidine
  modified_base 10: mod_base = OTHER; note = 2'-O-methylcytidine
  modified_base 11: mod_base = OTHER; note = 2'-O-methyluridine
  modified_base 12: mod_base = OTHER; note = 2'-O-methylguanosine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methyluridine
  modified_base 16: mod_base = OTHER; note = 2'-O-methylcytidine
  modified_base 17: mod_base = OTHER; note = 2'-O-methyluridine
  modified_base 18: mod_base = OTHER; note = 2'-O-methyluridine
  modified_base 19: mod_base = OTHER; note = 2'-O-methyluridine
  modified_base 20: mod_base = OTHER; note = 2'-O-methyladenosine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluorocytidine
  modified_base 24: mod_base = OTHER; note = 2'-fluoroadenosine
  modified_base 25: mod_base = OTHER; note = 2'-O-methylguanosine
  modified_base 26: mod_base = OTHER; note = 2'-O-methylguanosine
  modified_base 27: mod_base = OTHER; note = 2'-O-methyladenosine
  modified_base 28: mod_base = OTHER; note = 2'-O-methyladenosine
  modified_base 29: mod_base = OTHER; note = 2'-O-methyluridine
  modified_base 30: mod_base = OTHER; note = 2'-O-methyluridine
  modified_base 31: mod_base = OTHER; note = 2'-O-methylcytidine
  modified_base 32: mod_base = OTHER; note = 2'-O-methylcytidine
  modified_base 33: mod_base = OTHER; note = 2'-O-methyluridine
  modified_base 34: mod_base = OTHER; note = 2'-O-methyladenosine

SEQ ID NO: 845 - RNA, 34 nt, synthetic construct; identical to SEQ ID NO: 593
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyluridine
  modified_base 4: mod_base = OTHER; note = 2'-O-methylguanosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methylguanosine
  modified_base 8: mod_base = OTHER; note = 2'-O-methylguanosine
  modified_base 9: mod_base = OTHER; note = 2'-O-methyladenosine
  modified_base 10: mod_base = OTHER; note = 2'-O-methylguanosine
  modified_base 11: mod_base = OTHER; note = 2'-O-methyluridine
  modified_base 12: mod_base = OTHER; note = 2'-O-methylcytidine
  modified_base 13: mod_base = OTHER; note = 2'-O-methyluridine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methylguanosine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methylguanosine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluoroadenosine
  modified_base 23: mod_base = OTHER; note = 2'-fluoroguanosine
  modified_base 24: mod_base = OTHER; note = 2'-fluoroadenosine
  modified_base 25: mod_base = OTHER; note = 2'-O-methylcytidine
  modified_base 26: mod_base = OTHER; note = 2'-O-methyluridine
  modified_base 27: mod_base = OTHER; note = 2'-O-methylcytidine
  modified_base 28: mod_base = OTHER; note = 2'-O-methylcytidine
  modified_base 29: mod_base = OTHER; note = 2'-O-methyluridine
  modified_base 30: mod_base = OTHER; note = 2'-O-methyluridine
  modified_base 31: mod_base = OTHER; note = 2'-O-methylcytidine
  modified_base 32: mod_base = OTHER; note = 2'-O-methyladenosine
  modified_base 33: mod_base = OTHER; note = 2'-O-methyluridine
  modified_base 34: mod_base = OTHER; note = 2'-O-methyladenosine

SEQ ID NO: 846 - RNA, 34 nt, synthetic construct; identical to SEQ ID NO: 594
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-O-methylguanosine
  modified_base 5: mod_base = OTHER; note = 2'-O-methylcytidine
  modified_base 6: mod_base = OTHER; note = 2'-O-methyluridine
  modified_base 7: mod_base = OTHER; note = 2'-O-methyluridine
  modified_base 8: mod_base = OTHER; note = 2'-O-methylcytidine
  modified_base 9: mod_base = OTHER; note = 2'-O-methylguanosine
  modified_base 10: mod_base = OTHER; note = 2'-O-methylguanosine
  modified_base 11: mod_base = OTHER; note = 2'-O-methylcytidine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methylcytidine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methyluridine
  modified_base 19: mod_base = OTHER; note = 2'-O-methyluridine
  modified_base 20: mod_base = OTHER; note = 2'-O-methylguanosine
  modified_base 21: mod_base = OTHER; note = 2'-O-methylguanosine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluoroguanosine
  modified_base 25: mod_base = OTHER; note = 2'-O-methylcytidine
  modified_base 26: mod_base = OTHER; note = 2'-O-methylcytidine
  modified_base 27: mod_base = OTHER; note = 2'-O-methylguanosine
  modified_base 28: mod_base = OTHER; note = 2'-O-methyladenosine
  modified_base 29: mod_base = OTHER; note = 2'-O-methyladenosine
  modified_base 30: mod_base = OTHER; note = 2'-O-methylguanosine
  modified_base 31: mod_base = OTHER; note = 2'-O-methylcytidine
  modified_base 32: mod_base = OTHER; note = 2'-O-methyluridine
  modified_base 33: mod_base = OTHER; note = 2'-O-methyluridine
  modified_base 34: mod_base = OTHER; note = 2'-O-methyladenosine

SEQ ID NO: 847 - RNA, 34 nt, synthetic construct; identical to SEQ ID NO: 595
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylguanosine
  modified_base 4: mod_base = OTHER; note = 2'-O-methyladenosine
  modified_base 5: mod_base = OTHER; note = 2'-O-methylcytidine
  modified_base 6: mod_base = OTHER; note = 2'-O-methyluridine
  modified_base 7: mod_base = OTHER; note = 2'-O-methyluridine
  modified_base 8: mod_base = OTHER; note = 2'-O-methyluridine
  modified_base 9: mod_base = OTHER; note = 2'-O-methylguanosine
  modified_base 10: mod_base = OTHER; note = 2'-O-methyluridine
  modified_base 11: mod_base = OTHER; note = 2'-O-methylcytidine
  modified_base 12: mod_base = OTHER; note = 2'-O-methyladenosine
  modified_base 13: mod_base = OTHER; note = 2'-O-methyluridine
  modified_base 14: mod_base = OTHER; note = 2'-fluoroadenosine
  modified_base 15: mod_base = OTHER; note = 2'-O-methylguanosine
  modified_base 16: mod_base = OTHER; note = 2'-O-methylcytidine
  modified_base 17: mod_base = OTHER; note = 2'-O-methylcytidine
  modified_base 18: mod_base = OTHER; note = 2'-O-methyluridine
  modified_base 19: mod_base = OTHER; note = 2'-O-methylguanosine
  modified_base 20: mod_base = OTHER; note = 2'-O-methylcytidine
  modified_base 21: mod_base = OTHER; note = 2'-O-methyluridine
  modified_base 22: mod_base = OTHER; note = 2'-fluoroadenosine
  modified_base 23: mod_base = OTHER; note = 2'-fluorouridine
  modified_base 24: mod_base = OTHER; note = 2'-fluoroguanosine
  modified_base 25: mod_base = OTHER; note = 2'-O-methyladenosine
  modified_base 26: mod_base = OTHER; note = 2'-O-methylcytidine
  modified_base 27: mod_base = OTHER; note = 2'-O-methyladenosine
  modified_base 28: mod_base = OTHER; note = 2'-O-methyladenosine
  modified_base 29: mod_base = OTHER; note = 2'-O-methyladenosine
  modified_base 30: mod_base = OTHER; note = 2'-O-methylguanosine
  modified_base 31: mod_base = OTHER; note = 2'-O-methyluridine
  modified_base 32: mod_base = OTHER; note = 2'-O-methylcytidine
  modified_base 33: mod_base = OTHER; note = 2'-O-methyladenosine
  modified_base 34: mod_base = OTHER; note = 2'-O-methyladenosine

SEQ ID NO: 848 - RNA, 34 nt, synthetic construct; identical to SEQ ID NO: 596
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylcytidine
  modified_base 4: mod_base = OTHER; note = 2'-O-methylcytidine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methylguanosine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methylguanosine
  modified_base 11: mod_base = OTHER; note = 2'-O-methyladenosine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyluridine
  modified_base 16: mod_base = OTHER; note = 2'-O-methylcytidine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methylguanosine
  modified_base 20: mod_base = OTHER; note = 2'-O-methyladenosine
  modified_base 21: mod_base = OTHER; note = 2'-O-methylguanosine
  modified_base 22: mod_base = OTHER; note = 2'-fluorouridine
  modified_base 23: mod_base = OTHER; note = 2'-fluorouridine
  modified_base 24: mod_base = OTHER; note = 2'-fluorouridine
  modified_base 25: mod_base = OTHER; note = 2'-O-methylcytidine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methylcytidine
  modified_base 29: mod_base = OTHER; note = 2'-O-methyluridine
  modified_base 30: mod_base = OTHER; note = 2'-O-methyluridine
  modified_base 31: mod_base = OTHER; note = 2'-O-methylguanosine
  modified_base 32: mod_base = OTHER; note = 2'-O-methylguanosine
  modified_base 33: mod_base = OTHER; note = 2'-O-methyladenosine
  modified_base 34: mod_base = OTHER; note = 2'-O-methyladenosine

SEQ ID NO: 849 - RNA, 34 nt, synthetic construct; identical to SEQ ID NO: 597
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methylcytidine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyluridine
  modified_base 8: mod_base = OTHER; note = 2'-O-methylcytidine
  modified_base 9: mod_base = OTHER; note = 2'-O-methylcytidine
  modified_base 10: mod_base = OTHER; note = 2'-O-methyluridine
  modified_base 11: mod_base = OTHER; note = 2'-O-methylcytidine
  modified_base 12: mod_base = OTHER; note = 2'-O-methyladenosine
  modified_base 13: mod_base = OTHER; note = 2'-O-methyluridine
  modified_base 14: mod_base = OTHER; note = 2'-fluorocytidine
  modified_base 15: mod_base = OTHER; note = 2'-O-methyluridine
  modified_base 16: mod_base = OTHER; note = 2'-O-methyluridine
  modified_base 17: mod_base = OTHER; note = 2'-O-methylguanosine
  modified_base 18: mod_base = OTHER; note = 2'-O-methylguanosine
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methylguanosine
  modified_base 22: mod_base = OTHER; note = 2'-fluoroadenosine
  modified_base 23: mod_base = OTHER; note = 2'-fluorouridine
  modified_base 24: mod_base = OTHER; note = 2'-fluoroguanosine
  modified_base 25: mod_base = OTHER; note = 2'-O-methyladenosine
  modified_base 26: mod_base = OTHER; note = 2'-O-methylguanosine
  modified_base 27: mod_base = OTHER; note = 2'-O-methylguanosine
  modified_base 28: mod_base = OTHER; note = 2'-O-methyladenosine
  modified_base 29: mod_base = OTHER; note = 2'-O-methyluridine
  modified_base 30: mod_base = OTHER; note = 2'-O-methyluridine
  modified_base 31: mod_base = OTHER; note = 2'-O-methyluridine
  modified_base 32: mod_base = OTHER; note = 2'-O-methylguanosine
  modified_base 33: mod_base = OTHER; note = 2'-O-methylguanosine
  modified_base 34: mod_base = OTHER; note = 2'-O-methyladenosine

SEQ ID NO: 850 - RNA, 34 nt, synthetic construct; identical to SEQ ID NO: 598
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methylguanosine
  modified_base 5: mod_base = OTHER; note = 2'-O-methylcytidine
  modified_base 6: mod_base = OTHER; note = 2'-O-methyluridine
  modified_base 7: mod_base = OTHER; note = 2'-O-methylguanosine
  modified_base 8: mod_base = OTHER; note = 2'-O-methyluridine
  modified_base 9: mod_base = OTHER; note = 2'-O-methyluridine
  modified_base 10: mod_base = OTHER; note = 2'-O-methyluridine
  modified_base 11: mod_base = OTHER; note = 2'-O-methyluridine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyluridine
  modified_base 16: mod_base = OTHER; note = 2'-O-methylcytidine
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyluridine
  modified_base 20: mod_base = OTHER; note = 2'-O-methyladenosine
  modified_base 21: mod_base = OTHER; note = 2'-O-methyladenosine
  modified_base 22: mod_base = OTHER; note = 2'-fluorouridine
  modified_base 23: mod_base = OTHER; note = 2'-fluorouridine
  modified_base 24: mod_base = OTHER; note = 2'-fluoroadenosine
  modified_base 25: mod_base = OTHER; note = 2'-O-methyladenosine
  modified_base 26: mod_base = OTHER; note = 2'-O-methyladenosine
  modified_base 27: mod_base = OTHER; note = 2'-O-methyladenosine
  modified_base 28: mod_base = OTHER; note = 2'-O-methylcytidine
  modified_base 29: mod_base = OTHER; note = 2'-O-methyladenosine
  modified_base 30: mod_base = OTHER; note = 2'-O-methylguanosine
  modified_base 31: mod_base = OTHER; note = 2'-O-methylcytidine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 851 - RNA, 34 nt, synthetic construct; identical to SEQ ID NO: 599
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-O-methylcytidine
  modified_base 5: mod_base = OTHER; note = 2'-O-methylguanosine
  modified_base 6: mod_base = OTHER; note = 2'-O-methyladenosine
  modified_base 7: mod_base = OTHER; note = 2'-O-methylcytidine
  modified_base 8: mod_base = OTHER; note = 2'-O-methyluridine
  modified_base 9: mod_base = OTHER; note = 2'-O-methyluridine
  modified_base 10: mod_base = OTHER; note = 2'-O-methylcytidine
  modified_base 11: mod_base = OTHER; note = 2'-O-methyluridine
  modified_base 12: mod_base = OTHER; note = 2'-O-methylcytidine
  modified_base 13: mod_base = OTHER; note = 2'-O-methyluridine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methyluridine
  modified_base 17: mod_base = OTHER; note = 2'-O-methylguanosine
  modified_base 18: mod_base = OTHER; note = 2'-O-methyladenosine
  modified_base 19: mod_base = OTHER; note = 2'-O-methyladenosine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluoroadenosine
  modified_base 23: mod_base = OTHER; note = 2'-fluoroguanosine
  modified_base 24: mod_base = OTHER; note = 2'-fluoroadenosine
  modified_base 25: mod_base = OTHER; note = 2'-O-methylguanosine
  modified_base 26: mod_base = OTHER; note = 2'-O-methyladenosine
  modified_base 27: mod_base = OTHER; note = 2'-O-methyladenosine
  modified_base 28: mod_base = OTHER; note = 2'-O-methylguanosine
  modified_base 29: mod_base = OTHER; note = 2'-O-methyluridine
  modified_base 30: mod_base = OTHER; note = 2'-O-methylcytidine
  modified_base 31: mod_base = OTHER; note = 2'-O-methylguanosine
  modified_base 32: mod_base = OTHER; note = 2'-O-methyluridine
  modified_base 33: mod_base = OTHER; note = 2'-O-methyluridine
  modified_base 34: mod_base = OTHER; note = 2'-O-methyladenosine

SEQ ID NO: 852 - RNA, 34 nt, synthetic construct; identical to SEQ ID NO: 600
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methylcytidine
  modified_base 4: mod_base = OTHER; note = 2'-O-methylguanosine
  modified_base 5: mod_base = OTHER; note = 2'-O-methylguanosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methylcytidine
  modified_base 9: mod_base = OTHER; note = 2'-O-methyladenosine
  modified_base 10: mod_base = OTHER; note = 2'-O-methyluridine
  modified_base 11: mod_base = OTHER; note = 2'-O-methylcytidine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methylguanosine
  modified_base 16: mod_base = OTHER; note = 2'-O-methylcytidine
  modified_base 17: mod_base = OTHER; note = 2'-O-methylguanosine
  modified_base 18: mod_base = OTHER; note = 2'-O-methylguanosine
  modified_base 19: mod_base = OTHER; note = 2'-O-methylguanosine
  modified_base 20: mod_base = OTHER; note = 2'-O-methylcytidine
  modified_base 21: mod_base = OTHER; note = 2'-O-methyluridine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluoroguanosine
  modified_base 25: mod_base = OTHER; note = 2'-O-methyladenosine
  modified_base 26: mod_base = OTHER; note = 2'-O-methyluridine
  modified_base 27: mod_base = OTHER; note = 2'-O-methylguanosine
  modified_base 28: mod_base = OTHER; note = 2'-O-methyluridine
  modified_base 29: mod_base = OTHER; note = 2'-O-methyluridine
  modified_base 30: mod_base = OTHER; note = 2'-O-methylcytidine
  modified_base 31: mod_base = OTHER; note = 2'-O-methylcytidine
  modified_base 32: mod_base = OTHER; note = 2'-O-methylguanosine
  modified_base 33: mod_base = OTHER; note = 2'-O-methylguanosine
  modified_base 34: mod_base = OTHER; note = 2'-O-methyladenosine

SEQ ID NO: 853 - RNA, 34 nt, synthetic construct; identical to SEQ ID NO: 601
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methylcytidine
  modified_base 7: mod_base = OTHER; note = 2'-O-methyladenosine
  modified_base 8: mod_base = OTHER; note = 2'-O-methylcytidine
  modified_base 9: mod_base = OTHER; note = 2'-O-methyladenosine
  modified_base 10: mod_base = OTHER; note = 2'-O-methyluridine
  modified_base 11: mod_base = OTHER; note = 2'-O-methyladenosine
  modified_base 12: mod_base = OTHER; note = 2'-O-methylguanosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methylcytidine
  modified_base 19: mod_base = OTHER; note = 2'-O-methyladenosine
  modified_base 20: mod_base = OTHER; note = 2'-O-methyluridine
  modified_base 21: mod_base = OTHER; note = 2'-O-methylguanosine
  modified_base 22: mod_base = OTHER; note = 2'-fluorouridine
  modified_base 23: mod_base = OTHER; note = 2'-fluorocytidine
  modified_base 24: mod_base = OTHER; note = 2'-fluorouridine
  modified_base 25: mod_base = OTHER; note = 2'-O-methyladenosine
  modified_base 26: mod_base = OTHER; note = 2'-O-methyluridine
  modified_base 27: mod_base = OTHER; note = 2'-O-methylguanosine
  modified_base 28: mod_base = OTHER; note = 2'-O-methyluridine
  modified_base 29: mod_base = OTHER; note = 2'-O-methylguanosine
  modified_base 30: mod_base = OTHER; note = 2'-O-methyluridine
  modified_base 31: mod_base = OTHER; note = 2'-O-methyluridine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 854 - RNA, 34 nt, synthetic construct; identical to SEQ ID NO: 602
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methyluridine
  modified_base 4: mod_base = OTHER; note = 2'-O-methylcytidine
  modified_base 5: mod_base = OTHER; note = 2'-O-methyladenosine
  modified_base 6: mod_base = OTHER; note = 2'-O-methylcytidine
  modified_base 7: mod_base = OTHER; note = 2'-O-methyladenosine
  modified_base 8: mod_base = OTHER; note = 2'-O-methylcytidine
  modified_base 9: mod_base = OTHER; note = 2'-O-methylcytidine
  modified_base 10: mod_base = OTHER; note = 2'-O-methyladenosine
  modified_base 11: mod_base = OTHER; note = 2'-O-methyluridine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyluridine
  modified_base 16: mod_base = OTHER; note = 2'-O-methyluridine
  modified_base 17: mod_base = OTHER; note = 2'-O-methylguanosine
  modified_base 18: mod_base = OTHER; note = 2'-O-methylcytidine
  modified_base 19: mod_base = OTHER; note = 2'-O-methylcytidine
  modified_base 20: mod_base = OTHER; note = 2'-O-methyladenosine
  modified_base 21: mod_base = OTHER; note = 2'-O-methylguanosine
  modified_base 22: mod_base = OTHER; note = 2'-fluorouridine
  modified_base 23: mod_base = OTHER; note = 2'-fluorouridine
  modified_base 24: mod_base = OTHER; note = 2'-fluoroadenosine
  modified_base 25: mod_base = OTHER; note = 2'-O-methyluridine
  modified_base 26: mod_base = OTHER; note = 2'-O-methylguanosine
  modified_base 27: mod_base = OTHER; note = 2'-O-methylguanosine
  modified_base 28: mod_base = OTHER; note = 2'-O-methyluridine
  modified_base 29: mod_base = OTHER; note = 2'-O-methylguanosine
  modified_base 30: mod_base = OTHER; note = 2'-O-methyluridine
  modified_base 31: mod_base = OTHER; note = 2'-O-methylguanosine
  modified_base 32: mod_base = OTHER; note = 2'-O-methyladenosine
  modified_base 33: mod_base = OTHER; note = 2'-O-methyladenosine
  modified_base 34: mod_base = OTHER; note = 2'-O-methyladenosine

SEQ ID NO: 855 - RNA, 34 nt, synthetic construct; identical to SEQ ID NO: 603
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylcytidine
  modified_base 4: mod_base = OTHER; note = 2'-O-methyluridine
  modified_base 5: mod_base = OTHER; note = 2'-O-methylcytidine
  modified_base 6: mod_base = OTHER; note = 2'-O-methyluridine
  modified_base 7: mod_base = OTHER; note = 2'-O-methyluridine
  modified_base 8: mod_base = OTHER; note = 2'-O-methylguanosine
  modified_base 9: mod_base = OTHER; note = 2'-O-methyluridine
  modified_base 10: mod_base = OTHER; note = 2'-O-methylguanosine
  modified_base 11: mod_base = OTHER; note = 2'-O-methyladenosine
  modified_base 12: mod_base = OTHER; note = 2'-O-methyladenosine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methyladenosine
  modified_base 20: mod_base = OTHER; note = 2'-O-methyluridine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluorouridine
  modified_base 24: mod_base = OTHER; note = 2'-fluorouridine
  modified_base 25: mod_base = OTHER; note = 2'-O-methylcytidine
  modified_base 26: mod_base = OTHER; note = 2'-O-methyladenosine
  modified_base 27: mod_base = OTHER; note = 2'-O-methylcytidine
  modified_base 28: mod_base = OTHER; note = 2'-O-methyladenosine
  modified_base 29: mod_base = OTHER; note = 2'-O-methyladenosine
  modified_base 30: mod_base = OTHER; note = 2'-O-methylguanosine
  modified_base 31: mod_base = OTHER; note = 2'-O-methyladenosine
  modified_base 32: mod_base = OTHER; note = 2'-O-methylguanosine
  modified_base 33: mod_base = OTHER; note = 2'-O-methyladenosine
  modified_base 34: mod_base = OTHER; note = 2'-O-methyladenosine

SEQ ID NO: 856 - RNA, 34 nt, synthetic construct; identical to SEQ ID NO: 604
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyluridine
  modified_base 4: mod_base = OTHER; note = 2'-O-methyluridine
  modified_base 5: mod_base = OTHER; note = 2'-O-methylcytidine
  modified_base 6: mod_base = OTHER; note = 2'-O-methyladenosine
  modified_base 7: mod_base = OTHER; note = 2'-O-methylguanosine
  modified_base 8: mod_base = OTHER; note = 2'-O-methylguanosine
  modified_base 9: mod_base = OTHER; note = 2'-O-methyladenosine
  modified_base 10: mod_base = OTHER; note = 2'-O-methyladenosine
  modified_base 11: mod_base = OTHER; note = 2'-O-methyluridine
  modified_base 12: mod_base = OTHER; note = 2'-O-methyluridine
  modified_base 13: mod_base = OTHER; note = 2'-O-methylcytidine
  modified_base 14: mod_base = OTHER; note = 2'-fluorocytidine
  modified_base 15: mod_base = OTHER; note = 2'-O-methyluridine
  modified_base 16: mod_base = OTHER; note = 2'-O-methylguanosine
  modified_base 17: mod_base = OTHER; note = 2'-O-methylcytidine
  modified_base 18: mod_base = OTHER; note = 2'-O-methyluridine
  modified_base 19: mod_base = OTHER; note = 2'-O-methyluridine
  modified_base 20: mod_base = OTHER; note = 2'-O-methyladenosine
  modified_base 21: mod_base = OTHER; note = 2'-O-methylguanosine
  modified_base 22: mod_base = OTHER; note = 2'-fluoroguanosine
  modified_base 23: mod_base = OTHER; note = 2'-fluoroadenosine
  modified_base 24: mod_base = OTHER; note = 2'-fluoroadenosine
  modified_base 25: mod_base = OTHER; note = 2'-O-methyluridine
  modified_base 26: mod_base = OTHER; note = 2'-O-methyluridine
  modified_base 27: mod_base = OTHER; note = 2'-O-methylcytidine
  modified_base 28: mod_base = OTHER; note = 2'-O-methylcytidine
  modified_base 29: mod_base = OTHER; note = 2'-O-methyluridine
  modified_base 30: mod_base = OTHER; note = 2'-O-methylguanosine
  modified_base 31: mod_base = OTHER; note = 2'-O-methyladenosine
  modified_base 32: mod_base = OTHER; note = 2'-O-methyladenosine
  modified_base 33: mod_base = OTHER; note = 2'-O-methyluridine
  modified_base 34: mod_base = OTHER; note = 2'-O-methyladenosine

SEQ ID NO: 857 - RNA, 34 nt, synthetic construct; identical to SEQ ID NO: 605
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-O-methylcytidine
  modified_base 5: mod_base = OTHER; note = 2'-O-methyladenosine
  modified_base 6: mod_base = OTHER; note = 2'-O-methylcytidine
  modified_base 7: mod_base = OTHER; note = 2'-O-methyluridine
  modified_base 8: mod_base = OTHER; note = 2'-O-methyluridine
  modified_base 9: mod_base = OTHER; note = 2'-O-methyluridine
  modified_base 10: mod_base = OTHER; note = 2'-O-methylguanosine
  modified_base 11: mod_base = OTHER; note = 2'-O-methyladenosine
  modified_base 12: mod_base = OTHER; note = 2'-O-methylcytidine
  modified_base 13: mod_base = OTHER; note = 2'-O-methylcytidine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyluridine
  modified_base 19: mod_base = OTHER; note = 2'-O-methyluridine
  modified_base 20: mod_base = OTHER; note = 2'-O-methyluridine
  modified_base 21: mod_base = OTHER; note = 2'-O-methylguanosine
  modified_base 22: mod_base = OTHER; note = 2'-fluoroguanosine
  modified_base 23: mod_base = OTHER; note = 2'-fluoroguanosine
  modified_base 24: mod_base = OTHER; note = 2'-fluorouridine
  modified_base 25: mod_base = OTHER; note = 2'-O-methylcytidine
  modified_base 26: mod_base = OTHER; note = 2'-O-methyladenosine
  modified_base 27: mod_base = OTHER; note = 2'-O-methyladenosine
  modified_base 28: mod_base = OTHER; note = 2'-O-methyladenosine
  modified_base 29: mod_base = OTHER; note = 2'-O-methylguanosine
  modified_base 30: mod_base = OTHER; note = 2'-O-methyluridine
  modified_base 31: mod_base = OTHER; note = 2'-O-methylguanosine
  modified_base 32: mod_base = OTHER; note = 2'-O-methyluridine
  modified_base 33: mod_base = OTHER; note = 2'-O-methylcytidine
  modified_base 34: mod_base = OTHER; note = 2'-O-methyladenosine

SEQ ID NO: 858 - RNA, 34 nt, synthetic construct; identical to SEQ ID NO: 606
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methylcytidine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methylcytidine
  modified_base 9: mod_base = OTHER; note = 2'-O-methyladenosine
  modified_base 10: mod_base = OTHER; note = 2'-O-methylguanosine
  modified_base 11: mod_base = OTHER; note = 2'-O-methyladenosine
  modified_base 12: mod_base = OTHER; note = 2'-O-methylguanosine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methyluridine
  modified_base 16: mod_base = OTHER; note = 2'-O-methyluridine
  modified_base 17: mod_base = OTHER; note = 2'-O-methylguanosine
  modified_base 18: mod_base = OTHER; note = 2'-O-methyladenosine
  modified_base 19: mod_base = OTHER; note = 2'-O-methyluridine
  modified_base 20: mod_base = OTHER; note = 2'-O-methyladenosine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluorocytidine
  modified_base 24: mod_base = OTHER; note = 2'-fluorouridine
  modified_base 25: mod_base = OTHER; note = 2'-O-methylcytidine
  modified_base 26: mod_base = OTHER; note = 2'-O-methyluridine
  modified_base 27: mod_base = OTHER; note = 2'-O-methylguanosine
  modified_base 28: mod_base = OTHER; note = 2'-O-methyluridine
  modified_base 29: mod_base = OTHER; note = 2'-O-methyluridine
  modified_base 30: mod_base = OTHER; note = 2'-O-methyluridine
  modified_base 31: mod_base = OTHER; note = 2'-O-methylguanosine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 859 - RNA, 34 nt, synthetic construct; identical to SEQ ID NO: 607
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methylcytidine
  modified_base 7: mod_base = OTHER; note = 2'-O-methyladenosine
  modified_base 8: mod_base = OTHER; note = 2'-O-methylguanosine
  modified_base 9: mod_base = OTHER; note = 2'-O-methyladenosine
  modified_base 10: mod_base = OTHER; note = 2'-O-methylguanosine
  modified_base 11: mod_base = OTHER; note = 2'-O-methylcytidine
  modified_base 12: mod_base = OTHER; note = 2'-O-methyluridine
  modified_base 13: mod_base = OTHER; note = 2'-O-methyluridine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methyladenosine
  modified_base 17: mod_base = OTHER; note = 2'-O-methyluridine
  modified_base 18: mod_base = OTHER; note = 2'-O-methyladenosine
  modified_base 19: mod_base = OTHER; note = 2'-O-methyluridine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluoroadenosine
  modified_base 23: mod_base = OTHER; note = 2'-fluoroadenosine
  modified_base 24: mod_base = OTHER; note = 2'-fluoroguanosine
  modified_base 25: mod_base = OTHER; note = 2'-O-methylcytidine
  modified_base 26: mod_base = OTHER; note = 2'-O-methyluridine
  modified_base 27: mod_base = OTHER; note = 2'-O-methylcytidine
  modified_base 28: mod_base = OTHER; note = 2'-O-methyluridine
  modified_base 29: mod_base = OTHER; note = 2'-O-methylguanosine
  modified_base 30: mod_base = OTHER; note = 2'-O-methyluridine
  modified_base 31: mod_base = OTHER; note = 2'-O-methyluridine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 860 - RNA, 34 nt, synthetic construct; identical to SEQ ID NO: 608
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methyluridine
  modified_base 4: mod_base = OTHER; note = 2'-O-methylguanosine
  modified_base 5: mod_base = OTHER; note = 2'-O-methylguanosine
  modified_base 6: mod_base = OTHER; note = 2'-O-methyladenosine
  modified_base 7: mod_base = OTHER; note = 2'-O-methylguanosine
  modified_base 8: mod_base = OTHER; note = 2'-O-methyluridine
  modified_base 9: mod_base = OTHER; note = 2'-O-methyluridine
  modified_base 10: mod_base = OTHER; note = 2'-O-methyluridine
  modified_base 11: mod_base = OTHER; note = 2'-O-methylcytidine
  modified_base 12: mod_base = OTHER; note = 2'-O-methyluridine
  modified_base 13: mod_base = OTHER; note = 2'-O-methylcytidine
  modified_base 14: mod_base = OTHER; note = 2'-fluorocytidine
  modified_base 15: mod_base = OTHER; note = 2'-O-methyluridine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methylguanosine
  modified_base 20: mod_base = OTHER; note = 2'-O-methyladenosine
  modified_base 21: mod_base = OTHER; note = 2'-O-methylguanosine
  modified_base 22: mod_base = OTHER; note = 2'-fluoroguanosine
  modified_base 23: mod_base = OTHER; note = 2'-fluoroadenosine
  modified_base 24: mod_base = OTHER; note = 2'-fluoroguanosine
  modified_base 25: mod_base = OTHER; note = 2'-O-methyladenosine
  modified_base 26: mod_base = OTHER; note = 2'-O-methyladenosine
  modified_base 27: mod_base = OTHER; note = 2'-O-methyladenosine
  modified_base 28: mod_base = OTHER; note = 2'-O-methylcytidine
  modified_base 29: mod_base = OTHER; note = 2'-O-methyluridine
  modified_base 30: mod_base = OTHER; note = 2'-O-methylcytidine
  modified_base 31: mod_base = OTHER; note = 2'-O-methylcytidine
  modified_base 32: mod_base = OTHER; note = 2'-O-methyladenosine
  modified_base 33: mod_base = OTHER; note = 2'-O-methyladenosine
  modified_base 34: mod_base = OTHER; note = 2'-O-methyladenosine

SEQ ID NO: 861 - RNA, 34 nt, synthetic construct; identical to SEQ ID NO: 609
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylcytidine
  modified_base 4: mod_base = OTHER; note = 2'-O-methyladenosine
  modified_base 5: mod_base = OTHER; note = 2'-O-methylcytidine
  modified_base 6: mod_base = OTHER; note = 2'-O-methyladenosine
  modified_base 7: mod_base = OTHER; note = 2'-O-methylcytidine
  modified_base 8: mod_base = OTHER; note = 2'-O-methylcytidine
  modified_base 9: mod_base = OTHER; note = 2'-O-methyladenosine
  modified_base 10: mod_base = OTHER; note = 2'-O-methyluridine
  modified_base 11: mod_base = OTHER; note = 2'-O-methyladenosine
  modified_base 12: mod_base = OTHER; note = 2'-O-methyladenosine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methyluridine
  modified_base 16: mod_base = OTHER; note = 2'-O-methylguanosine
  modified_base 17: mod_base = OTHER; note = 2'-O-methylcytidine
  modified_base 18: mod_base = OTHER; note = 2'-O-methylcytidine
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluorouridine
  modified_base 24: mod_base = OTHER; note = 2'-fluorouridine
  modified_base 25: mod_base = OTHER; note = 2'-O-methyladenosine
  modified_base 26: mod_base = OTHER; note = 2'-O-methyluridine
  modified_base 27: mod_base = OTHER; note = 2'-O-methylguanosine
  modified_base 28: mod_base = OTHER; note = 2'-O-methylguanosine
  modified_base 29: mod_base = OTHER; note = 2'-O-methyluridine
  modified_base 30: mod_base = OTHER; note = 2'-O-methylguanosine
  modified_base 31: mod_base = OTHER; note = 2'-O-methyluridine
  modified_base 32: mod_base = OTHER; note = 2'-O-methylguanosine
  modified_base 33: mod_base = OTHER; note = 2'-O-methyladenosine
  modified_base 34: mod_base = OTHER; note = 2'-O-methyladenosine

SEQ ID NO: 862 - RNA, 34 nt, synthetic construct; identical to SEQ ID NO: 610
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylguanosine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyluridine
  modified_base 7: mod_base = OTHER; note = 2'-O-methylguanosine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = OTHER; note = 2'-O-methylcytidine
  modified_base 12: mod_base = OTHER; note = 2'-O-methylguanosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyluridine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methyluridine
  modified_base 19: mod_base = OTHER; note = 2'-O-methylcytidine
  modified_base 20: mod_base = OTHER; note = 2'-O-methyladenosine
  modified_base 21: mod_base = OTHER; note = 2'-O-methylguanosine
  modified_base 22: mod_base = OTHER; note = 2'-fluorouridine
  modified_base 23: mod_base = OTHER; note = 2'-fluorocytidine
  modified_base 24: mod_base = OTHER; note = 2'-fluoroguanosine
  modified_base 25: mod_base = OTHER; note = 2'-O-methyluridine
  modified_base 26: mod_base = OTHER; note = 2'-O-methyluridine
  modified_base 27: mod_base = OTHER; note = 2'-O-methyluridine
  modified_base 28: mod_base = OTHER; note = 2'-O-methylcytidine
  modified_base 29: mod_base = OTHER; note = 2'-O-methyladenosine
  modified_base 30: mod_base = OTHER; note = 2'-O-methyluridine
  modified_base 31: mod_base = OTHER; note = 2'-O-methyluridine
  modified_base 32: mod_base = OTHER; note = 2'-O-methylcytidine
  modified_base 33: mod_base = OTHER; note = 2'-O-methyladenosine
  modified_base 34: mod_base = OTHER; note = 2'-O-methyladenosine

SEQ ID NO: 863 - RNA, 34 nt, synthetic construct; identical to SEQ ID NO: 611
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methylguanosine
  modified_base 5: mod_base = OTHER; note = 2'-O-methylguanosine
  modified_base 6: mod_base = OTHER; note = 2'-O-methyluridine
  modified_base 7: mod_base = OTHER; note = 2'-O-methyluridine
  modified_base 8: mod_base = OTHER; note = 2'-O-methyluridine
  modified_base 9: mod_base = OTHER; note = 2'-O-methyluridine
  modified_base 10: mod_base = OTHER; note = 2'-O-methylcytidine
  modified_base 11: mod_base = OTHER; note = 2'-O-methylcytidine
  modified_base 12: mod_base = OTHER; note = 2'-O-methyladenosine
  modified_base 13: mod_base = OTHER; note = 2'-O-methyluridine
  modified_base 14: mod_base = OTHER; note = 2'-fluoroadenosine
  modified_base 15: mod_base = OTHER; note = 2'-O-methyluridine
  modified_base 16: mod_base = OTHER; note = 2'-O-methylcytidine
  modified_base 17: mod_base = OTHER; note = 2'-O-methylcytidine
  modified_base 18: mod_base = OTHER; note = 2'-O-methyluridine
  modified_base 19: mod_base = OTHER; note = 2'-O-methyluridine
  modified_base 20: mod_base = OTHER; note = 2'-O-methyladenosine
  modified_base 21: mod_base = OTHER; note = 2'-O-methyluridine
  modified_base 22: mod_base = OTHER; note = 2'-fluoroadenosine
  modified_base 23: mod_base = OTHER; note = 2'-fluorouridine
  modified_base 24: mod_base = OTHER; note = 2'-fluoroguanosine
  modified_base 25: mod_base = OTHER; note = 2'-O-methylguanosine
  modified_base 26: mod_base = OTHER; note = 2'-O-methyladenosine
  modified_base 27: mod_base = OTHER; note = 2'-O-methyladenosine
  modified_base 28: mod_base = OTHER; note = 2'-O-methyladenosine
  modified_base 29: mod_base = OTHER; note = 2'-O-methyladenosine
  modified_base 30: mod_base = OTHER; note = 2'-O-methylcytidine
  modified_base 31: mod_base = OTHER; note = 2'-O-methylcytidine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 864 - RNA, 34 nt, synthetic construct; identical to SEQ ID NO: 612
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methylcytidine
  modified_base 4: mod_base = OTHER; note = 2'-O-methyladenosine
  modified_base 5: mod_base = OTHER; note = 2'-O-methyluridine
  modified_base 6: mod_base = OTHER; note = 2'-O-methylcytidine
  modified_base 7: mod_base = OTHER; note = 2'-O-methyluridine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methylcytidine
  modified_base 11: mod_base = OTHER; note = 2'-O-methyluridine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-O-methylguanosine
  modified_base 17: mod_base = OTHER; note = 2'-O-methylcytidine
  modified_base 18: mod_base = OTHER; note = 2'-O-methyluridine
  modified_base 19: mod_base = OTHER; note = 2'-O-methylguanosine
  modified_base 20: mod_base = OTHER; note = 2'-O-methyluridine
  modified_base 21: mod_base = OTHER; note = 2'-O-methylguanosine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluoroadenosine
  modified_base 25: mod_base = OTHER; note = 2'-O-methylguanosine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methyladenosine
  modified_base 29: mod_base = OTHER; note = 2'-O-methylguanosine
  modified_base 30: mod_base = OTHER; note = 2'-O-methyladenosine
  modified_base 31: mod_base = OTHER; note = 2'-O-methyluridine
  modified_base 32: mod_base = OTHER; note = 2'-O-methylguanosine
  modified_base 33: mod_base = OTHER; note = 2'-O-methylcytidine
  modified_base 34: mod_base = OTHER; note = 2'-O-methyladenosine

SEQ ID NO: 865 - RNA, 34 nt, synthetic construct; identical to SEQ ID NO: 613
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylcytidine
  modified_base 4: mod_base = OTHER; note = 2'-O-methyladenosine
  modified_base 5: mod_base = OTHER; note = 2'-O-methyluridine
  modified_base 6: mod_base = OTHER; note = 2'-O-methylcytidine
  modified_base 7: mod_base = OTHER; note = 2'-O-methylcytidine
  modified_base 8: mod_base = OTHER; note = 2'-O-methyladenosine
  modified_base 9: mod_base = OTHER; note = 2'-O-methylguanosine
  modified_base 10: mod_base = OTHER; note = 2'-O-methyladenosine
  modified_base 11: mod_base = OTHER; note = 2'-O-methyluridine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methylcytidine
  modified_base 16: mod_base = OTHER; note = 2'-O-methylcytidine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methylcytidine
  modified_base 20: mod_base = OTHER; note = 2'-O-methylguanosine
  modified_base 21: mod_base = OTHER; note = 2'-O-methyladenosine
  modified_base 22: mod_base = OTHER; note = 2'-fluorouridine
  modified_base 23: mod_base = OTHER; note = 2'-fluorouridine
  modified_base 24: mod_base = OTHER; note = 2'-fluoroadenosine
  modified_base 25: mod_base = OTHER; note = 2'-O-methyluridine
  modified_base 26: mod_base = OTHER; note = 2'-O-methylcytidine
  modified_base 27: mod_base = OTHER; note = 2'-O-methyluridine
  modified_base 28: mod_base = OTHER; note = 2'-O-methylguanosine
  modified_base 29: mod_base = OTHER; note = 2'-O-methylguanosine
  modified_base 30: mod_base = OTHER; note = 2'-O-methyladenosine
  modified_base 31: mod_base = OTHER; note = 2'-O-methyluridine
  modified_base 32: mod_base = OTHER; note = 2'-O-methylguanosine
  modified_base 33: mod_base = OTHER; note = 2'-O-methyluridine
  modified_base 34: mod_base = OTHER; note = 2'-O-methyladenosine

SEQ ID NO: 866 - RNA, 34 nt, synthetic construct; identical to SEQ ID NO: 614
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methylguanosine
  modified_base 4: mod_base = OTHER; note = 2'-O-methyladenosine
  modified_base 5: mod_base = OTHER; note = 2'-O-methylguanosine
  modified_base 6: mod_base = OTHER; note = 2'-O-methyluridine
  modified_base 7: mod_base = OTHER; note = 2'-O-methyluridine
  modified_base 8: mod_base = OTHER; note = 2'-O-methylguanosine
  modified_base 9: mod_base = OTHER; note = 2'-O-methyluridine
  modified_base 10: mod_base = OTHER; note = 2'-O-methyluridine
  modified_base 11: mod_base = OTHER; note = 2'-O-methylcytidine
  modified_base 12: mod_base = OTHER; note = 2'-O-methylcytidine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methylcytidine
  modified_base 16: mod_base = OTHER; note = 2'-O-methylguanosine
  modified_base 17: mod_base = OTHER; note = 2'-O-methylguanosine
  modified_base 18: mod_base = OTHER; note = 2'-O-methyluridine
  modified_base 19: mod_base = OTHER; note = 2'-O-methylguanosine
  modified_base 20: mod_base = OTHER; note = 2'-O-methylguanosine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluoroguanosine
  modified_base 24: mod_base = OTHER; note = 2'-fluoroguanosine
  modified_base 25: mod_base = OTHER; note = 2'-O-methyladenosine
  modified_base 26: mod_base = OTHER; note = 2'-O-methyladenosine
  modified_base 27: mod_base = OTHER; note = 2'-O-methylcytidine
  modified_base 28: mod_base = OTHER; note = 2'-O-methyladenosine
  modified_base 29: mod_base = OTHER; note = 2'-O-methyladenosine
  modified_base 30: mod_base = OTHER; note = 2'-O-methylcytidine
  modified_base 31: mod_base = OTHER; note = 2'-O-methyluridine
  modified_base 32: mod_base = OTHER; note = 2'-O-methylcytidine
  modified_base 33: mod_base = OTHER; note = 2'-O-methylguanosine
  modified_base 34: mod_base = OTHER; note = 2'-O-methyladenosine

SEQ ID NO: 867 - RNA, 34 nt, synthetic construct; identical to SEQ ID NO: 615
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylcytidine
  modified_base 4: mod_base = OTHER; note = 2'-O-methyladenosine
  modified_base 5: mod_base = OTHER; note = 2'-O-methylcytidine
  modified_base 6: mod_base = OTHER; note = 2'-O-methyladenosine
  modified_base 7: mod_base = OTHER; note = 2'-O-methyluridine
  modified_base 8: mod_base = OTHER; note = 2'-O-methylguanosine
  modified_base 9: mod_base = OTHER; note = 2'-O-methyluridine
  modified_base 10: mod_base = OTHER; note = 2'-O-methyluridine
  modified_base 11: mod_base = OTHER; note = 2'-O-methylguanosine
  modified_base 12: mod_base = OTHER; note = 2'-O-methylcytidine
  modified_base 13: mod_base = OTHER; note = 2'-O-methyluridine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-O-methyluridine
  modified_base 17: mod_base = OTHER; note = 2'-O-methyluridine
  modified_base 18: mod_base = OTHER; note = 2'-O-methylguanosine
  modified_base 19: mod_base = OTHER; note = 2'-O-methyluridine
  modified_base 20: mod_base = OTHER; note = 2'-O-methyluridine
  modified_base 21: mod_base = OTHER; note = 2'-O-methylguanosine
  modified_base 22: mod_base = OTHER; note = 2'-fluoroadenosine
  modified_base 23: mod_base = OTHER; note = 2'-fluoroguanosine
  modified_base 24: mod_base = OTHER; note = 2'-fluorocytidine
  modified_base 25: mod_base = OTHER; note = 2'-O-methyladenosine
  modified_base 26: mod_base = OTHER; note = 2'-O-methyladenosine
  modified_base 27: mod_base = OTHER; note = 2'-O-methylcytidine
  modified_base 28: mod_base = OTHER; note = 2'-O-methyladenosine
  modified_base 29: mod_base = OTHER; note = 2'-O-methyluridine
  modified_base 30: mod_base = OTHER; note = 2'-O-methylguanosine
  modified_base 31: mod_base = OTHER; note = 2'-O-methyluridine
  modified_base 32: mod_base = OTHER; note = 2'-O-methylguanosine
  modified_base 33: mod_base = OTHER; note = 2'-O-methyluridine
  modified_base 34: mod_base = OTHER; note = 2'-O-methyladenosine

SEQ ID NO: 868 - RNA, 34 nt, synthetic construct; identical to SEQ ID NO: 616
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylcytidine
  modified_base 4: mod_base = OTHER; note = 2'-O-methyluridine
  modified_base 5: mod_base = OTHER; note = 2'-O-methylcytidine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyluridine
  modified_base 9: mod_base = OTHER; note = 2'-O-methyluridine
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-O-methylguanosine
  modified_base 13: mod_base = OTHER; note = 2'-O-methyluridine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methyladenosine
  modified_base 17: mod_base = OTHER; note = 2'-O-methylcytidine
  modified_base 18: mod_base = OTHER; note = 2'-O-methyluridine
  modified_base 19: mod_base = OTHER; note = 2'-O-methyladenosine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluoroadenosine
  modified_base 23: mod_base = OTHER; note = 2'-fluorocytidine
  modified_base 24: mod_base = OTHER; note = 2'-fluorouridine
  modified_base 25: mod_base = OTHER; note = 2'-O-methyluridine
  modified_base 26: mod_base = OTHER; note = 2'-O-methyladenosine
  modified_base 27: mod_base = OTHER; note = 2'-O-methyladenosine
  modified_base 28: mod_base = OTHER; note = 2'-O-methyluridine
  modified_base 29: mod_base = OTHER; note = 2'-O-methyluridine
  modified_base 30: mod_base = OTHER; note = 2'-O-methylguanosine
  modified_base 31: mod_base = OTHER; note = 2'-O-methyladenosine
  modified_base 32: mod_base = OTHER; note = 2'-O-methylguanosine
  modified_base 33: mod_base = OTHER; note = 2'-O-methyladenosine
  modified_base 34: mod_base = OTHER; note = 2'-O-methyladenosine

SEQ ID NO: 869 - RNA, 34 nt, synthetic construct; identical to SEQ ID NO: 617
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methylguanosine
  modified_base 6: mod_base = OTHER; note = 2'-O-methylcytidine
  modified_base 7: mod_base = OTHER; note = 2'-O-methylcytidine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = OTHER; note = 2'-O-methylguanosine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyluridine
  modified_base 16: mod_base = OTHER; note = 2'-O-methylguanosine
  modified_base 17: mod_base = OTHER; note = 2'-O-methyladenosine
  modified_base 18: mod_base = OTHER; note = 2'-O-methyluridine
  modified_base 19: mod_base = OTHER; note = 2'-O-methylguanosine
  modified_base 20: mod_base = OTHER; note = 2'-O-methyladenosine
  modified_base 21: mod_base = OTHER; note = 2'-O-methyladenosine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluorocytidine
  modified_base 25: mod_base = OTHER; note = 2'-O-methyluridine
  modified_base 26: mod_base = OTHER; note = 2'-O-methyluridine
  modified_base 27: mod_base = OTHER; note = 2'-O-methyluridine
  modified_base 28: mod_base = OTHER; note = 2'-O-methylguanosine
  modified_base 29: mod_base = OTHER; note = 2'-O-methylguanosine
  modified_base 30: mod_base = OTHER; note = 2'-O-methylcytidine
  modified_base 31: mod_base = OTHER; note = 2'-O-methyluridine
  modified_base 32: mod_base = OTHER; note = 2'-O-methyluridine
  modified_base 33: mod_base = OTHER; note = 2'-O-methylcytidine
  modified_base 34: mod_base = OTHER; note = 2'-O-methyladenosine

SEQ ID NO: 870 - RNA, 34 nt, synthetic construct; identical to SEQ ID NO: 618
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methylcytidine
  modified_base 4: mod_base = OTHER; note = 2'-O-methyladenosine
  modified_base 5: mod_base = OTHER; note = 2'-O-methylguanosine
  modified_base 6: mod_base = OTHER; note = 2'-O-methyluridine
  modified_base 7: mod_base = OTHER; note = 2'-O-methylguanosine
  modified_base 8: mod_base = OTHER; note = 2'-O-methylguanosine
  modified_base 9: mod_base = OTHER; note = 2'-O-methyladenosine
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-O-methylguanosine
  modified_base 13: mod_base = OTHER; note = 2'-O-methyladenosine
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methyluridine
  modified_base 19: mod_base = OTHER; note = 2'-O-methylcytidine
  modified_base 20: mod_base = OTHER; note = 2'-O-methyluridine
  modified_base 21: mod_base = OTHER; note = 2'-O-methylcytidine
  modified_base 22: mod_base = OTHER; note = 2'-fluorouridine
  modified_base 23: mod_base = OTHER; note = 2'-fluorocytidine
  modified_base 24: mod_base = OTHER; note = 2'-fluorouridine
  modified_base 25: mod_base = OTHER; note = 2'-O-methyluridine
  modified_base 26: mod_base = OTHER; note = 2'-O-methyluridine
  modified_base 27: mod_base = OTHER; note = 2'-O-methylcytidine
  modified_base 28: mod_base = OTHER; note = 2'-O-methylcytidine
  modified_base 29: mod_base = OTHER; note = 2'-O-methyladenosine
  modified_base 30: mod_base = OTHER; note = 2'-O-methylcytidine
  modified_base 31: mod_base = OTHER; note = 2'-O-methyluridine
  modified_base 32: mod_base = OTHER; note = 2'-O-methylguanosine
  modified_base 33: mod_base = OTHER; note = 2'-O-methylcytidine
  modified_base 34: mod_base = OTHER; note = 2'-O-methyladenosine

SEQ ID NO: 871 - RNA, 34 nt, synthetic construct; identical to SEQ ID NO: 619
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylcytidine
  modified_base 4: mod_base = OTHER; note = 2'-O-methyladenosine
  modified_base 5: mod_base = OTHER; note = 2'-O-methylcytidine
  modified_base 6: mod_base = OTHER; note = 2'-O-methyluridine
  modified_base 7: mod_base = OTHER; note = 2'-O-methylguanosine
  modified_base 8: mod_base = OTHER; note = 2'-O-methylcytidine
  modified_base 9: mod_base = OTHER; note = 2'-O-methylcytidine
  modified_base 10: mod_base = OTHER; note = 2'-O-methyluridine
  modified_base 11: mod_base = OTHER; note = 2'-O-methylguanosine
  modified_base 12: mod_base = OTHER; note = 2'-O-methylguanosine
  modified_base 13: mod_base = OTHER; note = 2'-O-methyladenosine
  modified_base 14: mod_base = OTHER; note = 2'-fluoroguanosine
  modified_base 15: mod_base = OTHER; note = 2'-O-methylguanosine
  modified_base 16: mod_base = OTHER; note = 2'-O-methylguanosine
  modified_base 17: mod_base = OTHER; note = 2'-O-methylcytidine
  modified_base 18: mod_base = OTHER; note = 2'-O-methylcytidine
  modified_base 19: mod_base = OTHER; note = 2'-O-methyluridine
  modified_base 20: mod_base = OTHER; note = 2'-O-methylcytidine
  modified_base 21: mod_base = OTHER; note = 2'-O-methylcytidine
  modified_base 22: mod_base = OTHER; note = 2'-fluorouridine
  modified_base 23: mod_base = OTHER; note = 2'-fluorocytidine
  modified_base 24: mod_base = OTHER; note = 2'-fluorocytidine
  modified_base 25: mod_base = OTHER; note = 2'-O-methyladenosine
  modified_base 26: mod_base = OTHER; note = 2'-O-methylguanosine
  modified_base 27: mod_base = OTHER; note = 2'-O-methylguanosine
  modified_base 28: mod_base = OTHER; note = 2'-O-methylcytidine
  modified_base 29: mod_base = OTHER; note = 2'-O-methyladenosine
  modified_base 30: mod_base = OTHER; note = 2'-O-methylguanosine
  modified_base 31: mod_base = OTHER; note = 2'-O-methyluridine
  modified_base 32: mod_base = OTHER; note = 2'-O-methylguanosine
  modified_base 33: mod_base = OTHER; note = 2'-O-methyluridine
  modified_base 34: mod_base = OTHER; note = 2'-O-methyladenosine

SEQ ID NO: 872 - RNA, 34 nt, synthetic construct; identical to SEQ ID NO: 620
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methyladenosine
  modified_base 4: mod_base = OTHER; note = 2'-O-methylguanosine
  modified_base 5: mod_base = OTHER; note = 2'-O-methyladenosine
  modified_base 6: mod_base = OTHER; note = 2'-O-methylcytidine
  modified_base 7: mod_base = OTHER; note = 2'-O-methylcytidine
  modified_base 8: mod_base = OTHER; note = 2'-O-methyluridine
  modified_base 9: mod_base = OTHER; note = 2'-O-methylguanosine
  modified_base 10: mod_base = OTHER; note = 2'-O-methylguanosine
  modified_base 11: mod_base = OTHER; note = 2'-O-methyluridine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-O-methyluridine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methylcytidine
  modified_base 20: mod_base = OTHER; note = 2'-O-methyluridine
  modified_base 21: mod_base = OTHER; note = 2'-O-methylguanosine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluoroadenosine
  modified_base 25: mod_base = OTHER; note = 2'-O-methylcytidine
  modified_base 26: mod_base = OTHER; note = 2'-O-methylcytidine
  modified_base 27: mod_base = OTHER; note = 2'-O-methyladenosine
  modified_base 28: mod_base = OTHER; note = 2'-O-methylguanosine
  modified_base 29: mod_base = OTHER; note = 2'-O-methylguanosine
  modified_base 30: mod_base = OTHER; note = 2'-O-methyluridine
  modified_base 31: mod_base = OTHER; note = 2'-O-methylcytidine
  modified_base 32: mod_base = OTHER; note = 2'-O-methyluridine
  modified_base 33: mod_base = OTHER; note = 2'-O-methyladenosine
  modified_base 34: mod_base = OTHER; note = 2'-O-methyladenosine

SEQ ID NO: 873 - RNA, 34 nt, synthetic construct; identical to SEQ ID NO: 621
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methylguanosine
  modified_base 5: mod_base = OTHER; note = 2'-O-methyladenosine
  modified_base 6: mod_base = OTHER; note = 2'-O-methylcytidine
  modified_base 7: mod_base = OTHER; note = 2'-O-methyladenosine
  modified_base 8: mod_base = OTHER; note = 2'-O-methylcytidine
  modified_base 9: mod_base = OTHER; note = 2'-O-methyladenosine
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-O-methylguanosine
  modified_base 17: mod_base = OTHER; note = 2'-O-methylcytidine
  modified_base 18: mod_base = OTHER; note = 2'-O-methyluridine
  modified_base 19: mod_base = OTHER; note = 2'-O-methyluridine
  modified_base 20: mod_base = OTHER; note = 2'-O-methyluridine
  modified_base 21: mod_base = OTHER; note = 2'-O-methylcytidine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluorouridine
  modified_base 25: mod_base = OTHER; note = 2'-O-methyluridine
  modified_base 26: mod_base = OTHER; note = 2'-O-methyluridine
  modified_base 27: mod_base = OTHER; note = 2'-O-methylguanosine
  modified_base 28: mod_base = OTHER; note = 2'-O-methyluridine
  modified_base 29: mod_base = OTHER; note = 2'-O-methylguanosine
  modified_base 30: mod_base = OTHER; note = 2'-O-methyluridine
  modified_base 31: mod_base = OTHER; note = 2'-O-methylcytidine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 874 - RNA, 34 nt, synthetic construct; identical to SEQ ID NO: 622
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-O-methylguanosine
  modified_base 5: mod_base = OTHER; note = 2'-O-methyluridine
  modified_base 6: mod_base = OTHER; note = 2'-O-methyluridine
  modified_base 7: mod_base = OTHER; note = 2'-O-methyluridine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methylcytidine
  modified_base 11: mod_base = OTHER; note = 2'-O-methylcytidine
  modified_base 12: mod_base = OTHER; note = 2'-O-methyluridine
  modified_base 13: mod_base = OTHER; note = 2'-O-methyluridine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-O-methylguanosine
  modified_base 17: mod_base = OTHER; note = 2'-O-methylcytidine
  modified_base 18: mod_base = OTHER; note = 2'-O-methylcytidine
  modified_base 19: mod_base = OTHER; note = 2'-O-methyladenosine
  modified_base 20: mod_base = OTHER; note = 2'-O-methyluridine
  modified_base 21: mod_base = OTHER; note = 2'-O-methylguanosine
  modified_base 22: mod_base = OTHER; note = 2'-fluoroadenosine
  modified_base 23: mod_base = OTHER; note = 2'-fluoroadenosine
  modified_base 24: mod_base = OTHER; note = 2'-fluoroguanosine
  modified_base 25: mod_base = OTHER; note = 2'-O-methylguanosine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methyladenosine
  modified_base 29: mod_base = OTHER; note = 2'-O-methyladenosine
  modified_base 30: mod_base = OTHER; note = 2'-O-methyladenosine
  modified_base 31: mod_base = OTHER; note = 2'-O-methylcytidine
  modified_base 32: mod_base = OTHER; note = 2'-O-methyluridine
  modified_base 33: mod_base = OTHER; note = 2'-O-methylcytidine
  modified_base 34: mod_base = OTHER; note = 2'-O-methyladenosine

SEQ ID NO: 875 - RNA, 34 nt, synthetic construct; identical to SEQ ID NO: 623
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyluridine
  modified_base 4: mod_base = OTHER; note = 2'-O-methylguanosine
  modified_base 5: mod_base = OTHER; note = 2'-O-methyluridine
  modified_base 6: mod_base = OTHER; note = 2'-O-methylguanosine
  modified_base 7: mod_base = OTHER; note = 2'-O-methylcytidine
  modified_base 8: mod_base = OTHER; note = 2'-O-methyluridine
  modified_base 9: mod_base = OTHER; note = 2'-O-methylguanosine
  modified_base 10: mod_base = OTHER; note = 2'-O-methylcytidine
  modified_base 11: mod_base = OTHER; note = 2'-O-methyluridine
  modified_base 12: mod_base = OTHER; note = 2'-O-methylguanosine
  modified_base 13: mod_base = OTHER; note = 2'-O-methyluridine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-O-methylguanosine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methylcytidine
  modified_base 20: mod_base = OTHER; note = 2'-O-methyluridine
  modified_base 21: mod_base = OTHER; note = 2'-O-methylguanosine
  modified_base 22: mod_base = OTHER; note = 2'-fluoroadenosine
  modified_base 23: mod_base = OTHER; note = 2'-fluorocytidine
  modified_base 24: mod_base = OTHER; note = 2'-fluoroadenosine
  modified_base 25: mod_base = OTHER; note = 2'-O-methylguanosine
  modified_base 26: mod_base = OTHER; note = 2'-O-methylcytidine
  modified_base 27: mod_base = OTHER; note = 2'-O-methyladenosine
  modified_base 28: mod_base = OTHER; note = 2'-O-methylguanosine
  modified_base 29: mod_base = OTHER; note = 2'-O-methylcytidine
  modified_base 30: mod_base = OTHER; note = 2'-O-methyladenosine
  modified_base 31: mod_base = OTHER; note = 2'-O-methylcytidine
  modified_base 32: mod_base = OTHER; note = 2'-O-methyladenosine
  modified_base 33: mod_base = OTHER; note = 2'-O-methyluridine
  modified_base 34: mod_base = OTHER; note = 2'-O-methyladenosine

SEQ ID NO: 876 - RNA, 34 nt, synthetic construct; identical to SEQ ID NO: 624
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methylguanosine
  modified_base 5: mod_base = OTHER; note = 2'-O-methyladenosine
  modified_base 6: mod_base = OTHER; note = 2'-O-methylguanosine
  modified_base 7: mod_base = OTHER; note = 2'-O-methylcytidine
  modified_base 8: mod_base = OTHER; note = 2'-O-methyluridine
  modified_base 9: mod_base = OTHER; note = 2'-O-methyluridine
  modified_base 10: mod_base = OTHER; note = 2'-O-methyluridine
  modified_base 11: mod_base = OTHER; note = 2'-O-methylguanosine
  modified_base 12: mod_base = OTHER; note = 2'-O-methyladenosine
  modified_base 13: mod_base = OTHER; note = 2'-O-methyluridine
  modified_base 14: mod_base = OTHER; note = 2'-fluoroadenosine
  modified_base 15: mod_base = OTHER; note = 2'-O-methyluridine
  modified_base 16: mod_base = OTHER; note = 2'-O-methylcytidine
  modified_base 17: mod_base = OTHER; note = 2'-O-methylcytidine
  modified_base 18: mod_base = OTHER; note = 2'-O-methyluridine
  modified_base 19: mod_base = OTHER; note = 2'-O-methylguanosine
  modified_base 20: mod_base = OTHER; note = 2'-O-methyladenosine
  modified_base 21: mod_base = OTHER; note = 2'-O-methyluridine
  modified_base 22: mod_base = OTHER; note = 2'-fluoroadenosine
  modified_base 23: mod_base = OTHER; note = 2'-fluorouridine
  modified_base 24: mod_base = OTHER; note = 2'-fluorocytidine
  modified_base 25: mod_base = OTHER; note = 2'-O-methyladenosine
  modified_base 26: mod_base = OTHER; note = 2'-O-methyladenosine
  modified_base 27: mod_base = OTHER; note = 2'-O-methyladenosine
  modified_base 28: mod_base = OTHER; note = 2'-O-methylguanosine
  modified_base 29: mod_base = OTHER; note = 2'-O-methylcytidine
  modified_base 30: mod_base = OTHER; note = 2'-O-methyluridine
  modified_base 31: mod_base = OTHER; note = 2'-O-methylcytidine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 877 - RNA, 34 nt, synthetic construct; identical to SEQ ID NO: 625
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-O-methyluridine
  modified_base 5: mod_base = OTHER; note = 2'-O-methyladenosine
  modified_base 6: mod_base = OTHER; note = 2'-O-methyluridine
  modified_base 7: mod_base = OTHER; note = 2'-O-methylcytidine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methylguanosine
  modified_base 11: mod_base = OTHER; note = 2'-O-methyluridine
  modified_base 12: mod_base = OTHER; note = 2'-O-methylguanosine
  modified_base 13: mod_base = OTHER; note = 2'-O-methylcytidine
  modified_base 14: mod_base = OTHER; note = 2'-fluoroadenosine
  modified_base 15: mod_base = OTHER; note = 2'-O-methylguanosine
  modified_base 16: mod_base = OTHER; note = 2'-O-methylguanosine
  modified_base 17: mod_base = OTHER; note = 2'-O-methylguanosine
  modified_base 18: mod_base = OTHER; note = 2'-O-methyladenosine
  modified_base 19: mod_base = OTHER; note = 2'-O-methylguanosine
  modified_base 20: mod_base = OTHER; note = 2'-O-methylcytidine
  modified_base 21: mod_base = OTHER; note = 2'-O-methyluridine
  modified_base 22: mod_base = OTHER; note = 2'-fluoroguanosine
  modified_base 23: mod_base = OTHER; note = 2'-fluorocytidine
  modified_base 24: mod_base = OTHER; note = 2'-fluoroadenosine
  modified_base 25: mod_base = OTHER; note = 2'-O-methylcytidine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methylguanosine
  modified_base 29: mod_base = OTHER; note = 2'-O-methyladenosine
  modified_base 30: mod_base = OTHER; note = 2'-O-methyluridine
  modified_base 31: mod_base = OTHER; note = 2'-O-methyladenosine
  modified_base 32: mod_base = OTHER; note = 2'-O-methyluridine
  modified_base 33: mod_base = OTHER; note = 2'-O-methylcytidine
  modified_base 34: mod_base = OTHER; note = 2'-O-methyladenosine

SEQ ID NO: 878 - RNA, 34 nt, synthetic construct; identical to SEQ ID NO: 626
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylguanosine
  modified_base 4: mod_base = OTHER; note = 2'-O-methylguanosine
  modified_base 5: mod_base = OTHER; note = 2'-O-methylguanosine
  modified_base 6: mod_base = OTHER; note = 2'-O-methylcytidine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-O-methylcytidine
  modified_base 10: mod_base = OTHER; note = 2'-O-methylguanosine
  modified_base 11: mod_base = OTHER; note = 2'-O-methyluridine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-O-methylguanosine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methyladenosine
  modified_base 20: mod_base = OTHER; note = 2'-O-methyluridine
  modified_base 21: mod_base = OTHER; note = 2'-O-methyladenosine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluoroadenosine
  modified_base 25: mod_base = OTHER; note = 2'-O-methylcytidine
  modified_base 26: mod_base = OTHER; note = 2'-O-methylguanosine
  modified_base 27: mod_base = OTHER; note = 2'-O-methyluridine
  modified_base 28: mod_base = OTHER; note = 2'-O-methyluridine
  modified_base 29: mod_base = OTHER; note = 2'-O-methylguanosine
  modified_base 30: mod_base = OTHER; note = 2'-O-methylcytidine
  modified_base 31: mod_base = OTHER; note = 2'-O-methylcytidine
  modified_base 32: mod_base = OTHER; note = 2'-O-methylcytidine
  modified_base 33: mod_base = OTHER; note = 2'-O-methyluridine
  modified_base 34: mod_base = OTHER; note = 2'-O-methyladenosine

SEQ ID NO: 879 - RNA, 34 nt, synthetic construct; identical to SEQ ID NO: 627
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylguanosine
  modified_base 4: mod_base = OTHER; note = 2'-O-methyladenosine
  modified_base 5: mod_base = OTHER; note = 2'-O-methylcytidine
  modified_base 6: mod_base = OTHER; note = 2'-O-methylcytidine
  modified_base 7: mod_base = OTHER; note = 2'-O-methyluridine
  modified_base 8: mod_base = OTHER; note = 2'-O-methyladenosine
  modified_base 9: mod_base = OTHER; note = 2'-O-methylguanosine
  modified_base 10: mod_base = OTHER; note = 2'-O-methyladenosine
  modified_base 11: mod_base = OTHER; note = 2'-O-methylcytidine
  modified_base 12: mod_base = OTHER; note = 2'-O-methylcytidine
  modified_base 13: mod_base = OTHER; note = 2'-O-methyluridine
  modified_base 14: mod_base = OTHER; note = 2'-fluoroguanosine
  modified_base 15: mod_base = OTHER; note = 2'-O-methylguanosine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methylcytidine
  modified_base 20: mod_base = OTHER; note = 2'-O-methylcytidine
  modified_base 21: mod_base = OTHER; note = 2'-O-methylcytidine
  modified_base 22: mod_base = OTHER; note = 2'-fluoroadenosine
  modified_base 23: mod_base = OTHER; note = 2'-fluoroguanosine
  modified_base 24: mod_base = OTHER; note = 2'-fluoroguanosine
  modified_base 25: mod_base = OTHER; note = 2'-O-methyluridine
  modified_base 26: mod_base = OTHER; note = 2'-O-methylcytidine
  modified_base 27: mod_base = OTHER; note = 2'-O-methyluridine
  modified_base 28: mod_base = OTHER; note = 2'-O-methyladenosine
  modified_base 29: mod_base = OTHER; note = 2'-O-methylguanosine
  modified_base 30: mod_base = OTHER; note = 2'-O-methylguanosine
  modified_base 31: mod_base = OTHER; note = 2'-O-methyluridine
  modified_base 32: mod_base = OTHER; note = 2'-O-methylcytidine
  modified_base 33: mod_base = OTHER; note = 2'-O-methyluridine
  modified_base 34: mod_base = OTHER; note = 2'-O-methyladenosine

SEQ ID NO: 880 - RNA, 34 nt, synthetic construct; identical to SEQ ID NO: 628
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylguanosine
  modified_base 4: mod_base = OTHER; note = 2'-O-methyluridine
  modified_base 5: mod_base = OTHER; note = 2'-O-methyladenosine
  modified_base 6: mod_base = OTHER; note = 2'-O-methylcytidine
  modified_base 7: mod_base = OTHER; note = 2'-O-methyluridine
  modified_base 8: mod_base = OTHER; note = 2'-O-methylcytidine
  modified_base 9: mod_base = OTHER; note = 2'-O-methyladenosine
  modified_base 10: mod_base = OTHER; note = 2'-O-methylguanosine
  modified_base 11: mod_base = OTHER; note = 2'-O-methyladenosine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methylcytidine
  modified_base 16: mod_base = OTHER; note = 2'-O-methyladenosine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methylguanosine
  modified_base 20: mod_base = OTHER; note = 2'-O-methylguanosine
  modified_base 21: mod_base = OTHER; note = 2'-O-methylguanosine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluorouridine
  modified_base 25: mod_base = OTHER; note = 2'-O-methylcytidine
  modified_base 26: mod_base = OTHER; note = 2'-O-methyluridine
  modified_base 27: mod_base = OTHER; note = 2'-O-methylguanosine
  modified_base 28: mod_base = OTHER; note = 2'-O-methyladenosine
  modified_base 29: mod_base = OTHER; note = 2'-O-methylguanosine
  modified_base 30: mod_base = OTHER; note = 2'-O-methyluridine
  modified_base 31: mod_base = OTHER; note = 2'-O-methyladenosine
  modified_base 32: mod_base = OTHER; note = 2'-O-methylcytidine
  modified_base 33: mod_base = OTHER; note = 2'-O-methyluridine
  modified_base 34: mod_base = OTHER; note = 2'-O-methyladenosine

SEQ ID NO: 881 - RNA, 34 nt, synthetic construct; identical to SEQ ID NO: 629
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-O-methylguanosine
  modified_base 5: mod_base = OTHER; note = 2'-O-methylguanosine
  modified_base 6: mod_base = OTHER; note = 2'-O-methylcytidine
  modified_base 7: mod_base = OTHER; note = 2'-O-methyluridine
  modified_base 8: mod_base = OTHER; note = 2'-O-methylcytidine
  modified_base 9: mod_base = OTHER; note = 2'-O-methylcytidine
  modified_base 10: mod_base = OTHER; note = 2'-O-methylguanosine
  modified_base 11: mod_base = OTHER; note = 2'-O-methyluridine
  modified_base 12: mod_base = OTHER; note = 2'-O-methylcytidine
  modified_base 13: mod_base = OTHER; note = 2'-O-methylcytidine
  modified_base 14: mod_base = OTHER; note = 2'-fluorocytidine
  modified_base 15: mod_base = OTHER; note = 2'-O-methylguanosine
  modified_base 16: mod_base = OTHER; note = 2'-O-methylcytidine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methylcytidine
  modified_base 20: mod_base = OTHER; note = 2'-O-methylcytidine
  modified_base 21: mod_base = OTHER; note = 2'-O-methylguanosine
  modified_base 22: mod_base = OTHER; note = 2'-fluoroguanosine
  modified_base 23: mod_base = OTHER; note = 2'-fluoroguanosine
  modified_base 24: mod_base = OTHER; note = 2'-fluoroadenosine
  modified_base 25: mod_base = OTHER; note = 2'-O-methylcytidine
  modified_base 26: mod_base = OTHER; note = 2'-O-methylguanosine
  modified_base 27: mod_base = OTHER; note = 2'-O-methylguanosine
  modified_base 28: mod_base = OTHER; note = 2'-O-methyladenosine
  modified_base 29: mod_base = OTHER; note = 2'-O-methylguanosine
  modified_base 30: mod_base = OTHER; note = 2'-O-methylcytidine
  modified_base 31: mod_base = OTHER; note = 2'-O-methylcytidine
  modified_base 32: mod_base = OTHER; note = 2'-O-methyluridine
  modified_base 33: mod_base = OTHER; note = 2'-O-methyluridine
  modified_base 34: mod_base = OTHER; note = 2'-O-methyladenosine

SEQ ID NO: 882 - RNA, 34 nt, synthetic construct; identical to SEQ ID NO: 630
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methylguanosine
  modified_base 4: mod_base = OTHER; note = 2'-O-methylguanosine
  modified_base 5: mod_base = OTHER; note = 2'-O-methylcytidine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methylcytidine
  modified_base 9: mod_base = OTHER; note = 2'-O-methylguanosine
  modified_base 10: mod_base = OTHER; note = 2'-O-methyluridine
  modified_base 11: mod_base = OTHER; note = 2'-O-methylcytidine
  modified_base 12: mod_base = OTHER; note = 2'-O-methyladenosine
  modified_base 13: mod_base = OTHER; note = 2'-O-methyluridine
  modified_base 14: mod_base = OTHER; note = 2'-fluoroadenosine
  modified_base 15: mod_base = OTHER; note = 2'-O-methylguanosine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methyluridine
  modified_base 20: mod_base = OTHER; note = 2'-O-methylcytidine
  modified_base 21: mod_base = OTHER; note = 2'-O-methyluridine
  modified_base 22: mod_base = OTHER; note = 2'-fluoroadenosine
  modified_base 23: mod_base = OTHER; note = 2'-fluorouridine
  modified_base 24: mod_base = OTHER; note = 2'-fluoroguanosine
  modified_base 25: mod_base = OTHER; note = 2'-O-methyladenosine
  modified_base 26: mod_base = OTHER; note = 2'-O-methylcytidine
  modified_base 27: mod_base = OTHER; note = 2'-O-methylguanosine
  modified_base 28: mod_base = OTHER; note = 2'-O-methyluridine
  modified_base 29: mod_base = OTHER; note = 2'-O-methyluridine
  modified_base 30: mod_base = OTHER; note = 2'-O-methylguanosine
  modified_base 31: mod_base = OTHER; note = 2'-O-methylcytidine
  modified_base 32: mod_base = OTHER; note = 2'-O-methylcytidine
  modified_base 33: mod_base = OTHER; note = 2'-O-methylcytidine
  modified_base 34: mod_base = OTHER; note = 2'-O-methyladenosine

SEQ ID NO: 883 - RNA, 34 nt, synthetic construct; identical to SEQ ID NO: 631
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyluridine
  modified_base 4: mod_base = OTHER; note = 2'-O-methylguanosine
  modified_base 5: mod_base = OTHER; note = 2'-O-methyluridine
  modified_base 6: mod_base = OTHER; note = 2'-O-methyluridine
  modified_base 7: mod_base = OTHER; note = 2'-O-methyluridine
  modified_base 8: mod_base = OTHER; note = 2'-O-methyluridine
  modified_base 9: mod_base = OTHER; note = 2'-O-methyladenosine
  modified_base 10: mod_base = OTHER; note = 2'-O-methyladenosine
  modified_base 11: mod_base = OTHER; note = 2'-O-methyluridine
  modified_base 12: mod_base = OTHER; note = 2'-O-methyluridine
  modified_base 13: mod_base = OTHER; note = 2'-O-methylcytidine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methylcytidine
  modified_base 19: mod_base = OTHER; note = 2'-O-methylcytidine
  modified_base 20: mod_base = OTHER; note = 2'-O-methyluridine
  modified_base 21: mod_base = OTHER; note = 2'-O-methyluridine
  modified_base 22: mod_base = OTHER; note = 2'-fluoroguanosine
  modified_base 23: mod_base = OTHER; note = 2'-fluoroadenosine
  modified_base 24: mod_base = OTHER; note = 2'-fluoroadenosine
  modified_base 25: mod_base = OTHER; note = 2'-O-methyluridine
  modified_base 26: mod_base = OTHER; note = 2'-O-methyluridine
  modified_base 27: mod_base = OTHER; note = 2'-O-methyladenosine
  modified_base 28: mod_base = OTHER; note = 2'-O-methyladenosine
  modified_base 29: mod_base = OTHER; note = 2'-O-methyladenosine
  modified_base 30: mod_base = OTHER; note = 2'-O-methyladenosine
  modified_base 31: mod_base = OTHER; note = 2'-O-methylcytidine
  modified_base 32: mod_base = OTHER; note = 2'-O-methyladenosine
  modified_base 33: mod_base = OTHER; note = 2'-O-methylguanosine
  modified_base 34: mod_base = OTHER; note = 2'-O-methyladenosine

SEQ ID NO: 884 - RNA, 34 nt, synthetic construct; identical to SEQ ID NO: 632
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylguanosine
  modified_base 4: mod_base = OTHER; note = 2'-O-methyladenosine
  modified_base 5: mod_base = OTHER; note = 2'-O-methylguanosine
  modified_base 6: mod_base = OTHER; note = 2'-O-methyladenosine
  modified_base 7: mod_base = OTHER; note = 2'-O-methyluridine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methylcytidine
  modified_base 11: mod_base = OTHER; note = 2'-O-methyladenosine
  modified_base 12: mod_base = OTHER; note = 2'-O-methyluridine
  modified_base 13: mod_base = OTHER; note = 2'-O-methylcytidine
  modified_base 14: mod_base = OTHER; note = 2'-fluoroadenosine
  modified_base 15: mod_base = OTHER; note = 2'-O-methylcytidine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methylcytidine
  modified_base 20: mod_base = OTHER; note = 2'-O-methylguanosine
  modified_base 21: mod_base = OTHER; note = 2'-O-methyluridine
  modified_base 22: mod_base = OTHER; note = 2'-fluoroguanosine
  modified_base 23: mod_base = OTHER; note = 2'-fluoroadenosine
  modified_base 24: mod_base = OTHER; note = 2'-fluorouridine
  modified_base 25: mod_base = OTHER; note = 2'-O-methylguanosine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methyladenosine
  modified_base 29: mod_base = OTHER; note = 2'-O-methyluridine
  modified_base 30: mod_base = OTHER; note = 2'-O-methylcytidine
  modified_base 31: mod_base = OTHER; note = 2'-O-methyluridine
  modified_base 32: mod_base = OTHER; note = 2'-O-methylcytidine
  modified_base 33: mod_base = OTHER; note = 2'-O-methyluridine
  modified_base 34: mod_base = OTHER; note = 2'-O-methyladenosine

SEQ ID NO: 885 - RNA, 34 nt, synthetic construct; identical to SEQ ID NO: 633
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methylguanosine
  modified_base 4: mod_base = OTHER; note = 2'-O-methyluridine
  modified_base 5: mod_base = OTHER; note = 2'-O-methylcytidine
  modified_base 6: mod_base = OTHER; note = 2'-O-methyluridine
  modified_base 7: mod_base = OTHER; note = 2'-O-methyluridine
  modified_base 8: mod_base = OTHER; note = 2'-O-methylcytidine
  modified_base 9: mod_base = OTHER; note = 2'-O-methyladenosine
  modified_base 10: mod_base = OTHER; note = 2'-O-methyluridine
  modified_base 11: mod_base = OTHER; note = 2'-O-methyladenosine
  modified_base 12: mod_base = OTHER; note = 2'-O-methyladenosine
  modified_base 13: mod_base = OTHER; note = 2'-O-methyluridine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methyladenosine
  modified_base 17: mod_base = OTHER; note = 2'-O-methyluridine
  modified_base 18: mod_base = OTHER; note = 2'-O-methyluridine
  modified_base 19: mod_base = OTHER; note = 2'-O-methyluridine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluoroadenosine
  modified_base 23: mod_base = OTHER; note = 2'-fluorouridine
  modified_base 24: mod_base = OTHER; note = 2'-fluorouridine
  modified_base 25: mod_base = OTHER; note = 2'-O-methyladenosine
  modified_base 26: mod_base = OTHER; note = 2'-O-methyluridine
  modified_base 27: mod_base = OTHER; note = 2'-O-methylguanosine
  modified_base 28: mod_base = OTHER; note = 2'-O-methyladenosine
  modified_base 29: mod_base = OTHER; note = 2'-O-methyladenosine
  modified_base 30: mod_base = OTHER; note = 2'-O-methylguanosine
  modified_base 31: mod_base = OTHER; note = 2'-O-methyladenosine
  modified_base 32: mod_base = OTHER; note = 2'-O-methylcytidine
  modified_base 33: mod_base = OTHER; note = 2'-O-methylcytidine
  modified_base 34: mod_base = OTHER; note = 2'-O-methyladenosine

SEQ ID NO: 886 - RNA, 34 nt, synthetic construct; identical to SEQ ID NO: 634
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methyluridine
  modified_base 5: mod_base = OTHER; note = 2'-O-methyladenosine
  modified_base 6: mod_base = OTHER; note = 2'-O-methyluridine
  modified_base 7: mod_base = OTHER; note = 2'-O-methylcytidine
  modified_base 8: mod_base = OTHER; note = 2'-O-methyluridine
  modified_base 9: mod_base = OTHER; note = 2'-O-methyluridine
  modified_base 10: mod_base = OTHER; note = 2'-O-methylguanosine
  modified_base 11: mod_base = OTHER; note = 2'-O-methylguanosine
  modified_base 12: mod_base = OTHER; note = 2'-O-methylcytidine
  modified_base 13: mod_base = OTHER; note = 2'-O-methyluridine
  modified_base 14: mod_base = OTHER; note = 2'-fluorouridine
  modified_base 15: mod_base = OTHER; note = 2'-O-methylcytidine
  modified_base 16: mod_base = OTHER; note = 2'-O-methyladenosine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methylcytidine
  modified_base 20: mod_base = OTHER; note = 2'-O-methylguanosine
  modified_base 21: mod_base = OTHER; note = 2'-O-methyladenosine
  modified_base 22: mod_base = OTHER; note = 2'-fluoroadenosine
  modified_base 23: mod_base = OTHER; note = 2'-fluoroguanosine
  modified_base 24: mod_base = OTHER; note = 2'-fluorocytidine
  modified_base 25: mod_base = OTHER; note = 2'-O-methylcytidine
  modified_base 26: mod_base = OTHER; note = 2'-O-methyladenosine
  modified_base 27: mod_base = OTHER; note = 2'-O-methyladenosine
  modified_base 28: mod_base = OTHER; note = 2'-O-methylguanosine
  modified_base 29: mod_base = OTHER; note = 2'-O-methyladenosine
  modified_base 30: mod_base = OTHER; note = 2'-O-methyluridine
  modified_base 31: mod_base = OTHER; note = 2'-O-methyladenosine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 887 - RNA, 34 nt, synthetic construct; identical to SEQ ID NO: 635
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methylcytidine
  modified_base 5: mod_base = OTHER; note = 2'-O-methylcytidine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methyluridine
  modified_base 11: mod_base = OTHER; note = 2'-O-methylguanosine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methylcytidine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluorouridine
  modified_base 23: mod_base = OTHER; note = 2'-fluorouridine
  modified_base 24: mod_base = OTHER; note = 2'-fluorocytidine
  modified_base 25: mod_base = OTHER; note = 2'-O-methyladenosine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methyluridine
  modified_base 29: mod_base = OTHER; note = 2'-O-methyluridine
  modified_base 30: mod_base = OTHER; note = 2'-O-methylguanosine
  modified_base 31: mod_base = OTHER; note = 2'-O-methylguanosine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 888 - RNA, 34 nt, synthetic construct; identical to SEQ ID NO: 636
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylguanosine
  modified_base 4: mod_base = OTHER; note = 2'-O-methylcytidine
  modified_base 5: mod_base = OTHER; note = 2'-O-methyluridine
  modified_base 6: mod_base = OTHER; note = 2'-O-methylguanosine
  modified_base 7: mod_base = OTHER; note = 2'-O-methyluridine
  modified_base 8: mod_base = OTHER; note = 2'-O-methyluridine
  modified_base 9: mod_base = OTHER; note = 2'-O-methyluridine
  modified_base 10: mod_base = OTHER; note = 2'-O-methyluridine
  modified_base 11: mod_base = OTHER; note = 2'-O-methyladenosine
  modified_base 12: mod_base = OTHER; note = 2'-O-methyladenosine
  modified_base 13: mod_base = OTHER; note = 2'-O-methyluridine
  modified_base 14: mod_base = OTHER; note = 2'-fluorouridine
  modified_base 15: mod_base = OTHER; note = 2'-O-methylcytidine
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyluridine
  modified_base 19: mod_base = OTHER; note = 2'-O-methylcytidine
  modified_base 20: mod_base = OTHER; note = 2'-O-methylguanosine
  modified_base 21: mod_base = OTHER; note = 2'-O-methyladenosine
  modified_base 22: mod_base = OTHER; note = 2'-fluoroadenosine
  modified_base 23: mod_base = OTHER; note = 2'-fluorouridine
  modified_base 24: mod_base = OTHER; note = 2'-fluorouridine
  modified_base 25: mod_base = OTHER; note = 2'-O-methyladenosine
  modified_base 26: mod_base = OTHER; note = 2'-O-methyladenosine
  modified_base 27: mod_base = OTHER; note = 2'-O-methyladenosine
  modified_base 28: mod_base = OTHER; note = 2'-O-methyladenosine
  modified_base 29: mod_base = OTHER; note = 2'-O-methylcytidine
  modified_base 30: mod_base = OTHER; note = 2'-O-methyladenosine
  modified_base 31: mod_base = OTHER; note = 2'-O-methylguanosine
  modified_base 32: mod_base = OTHER; note = 2'-O-methylcytidine
  modified_base 33: mod_base = OTHER; note = 2'-O-methyluridine
  modified_base 34: mod_base = OTHER; note = 2'-O-methyladenosine

SEQ ID NO: 889 - RNA, 34 nt, synthetic construct; identical to SEQ ID NO: 637
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methylcytidine
  modified_base 6: mod_base = OTHER; note = 2'-O-methyluridine
  modified_base 7: mod_base = OTHER; note = 2'-O-methyluridine
  modified_base 8: mod_base = OTHER; note = 2'-O-methylguanosine
  modified_base 9: mod_base = OTHER; note = 2'-O-methylcytidine
  modified_base 10: mod_base = OTHER; note = 2'-O-methylcytidine
  modified_base 11: mod_base = OTHER; note = 2'-O-methyladenosine
  modified_base 12: mod_base = OTHER; note = 2'-O-methylcytidine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methyluridine
  modified_base 16: mod_base = OTHER; note = 2'-O-methylcytidine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluoroguanosine
  modified_base 24: mod_base = OTHER; note = 2'-fluorouridine
  modified_base 25: mod_base = OTHER; note = 2'-O-methylguanosine
  modified_base 26: mod_base = OTHER; note = 2'-O-methylguanosine
  modified_base 27: mod_base = OTHER; note = 2'-O-methylcytidine
  modified_base 28: mod_base = OTHER; note = 2'-O-methyladenosine
  modified_base 29: mod_base = OTHER; note = 2'-O-methyladenosine
  modified_base 30: mod_base = OTHER; note = 2'-O-methylguanosine
  modified_base 31: mod_base = OTHER; note = 2'-O-methyluridine
  modified_base 32: mod_base = OTHER; note = 2'-O-methyluridine
  modified_base 33: mod_base = OTHER; note = 2'-O-methyladenosine
  modified_base 34: mod_base = OTHER; note = 2'-O-methyladenosine

SEQ ID NO: 890 - RNA, 34 nt, synthetic construct; identical to SEQ ID NO: 638
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylguanosine
  modified_base 4: mod_base = OTHER; note = 2'-O-methyladenosine
  modified_base 5: mod_base = OTHER; note = 2'-O-methylguanosine
  modified_base 6: mod_base = OTHER; note = 2'-O-methylcytidine
  modified_base 7: mod_base = OTHER; note = 2'-O-methyladenosine
  modified_base 8: mod_base = OTHER; note = 2'-O-methylguanosine
  modified_base 9: mod_base = OTHER; note = 2'-O-methylguanosine
  modified_base 10: mod_base = OTHER; note = 2'-O-methyluridine
  modified_base 11: mod_base = OTHER; note = 2'-O-methyladenosine
  modified_base 12: mod_base = OTHER; note = 2'-O-methylcytidine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methylcytidine
  modified_base 17: mod_base = OTHER; note = 2'-O-methyluridine
  modified_base 18: mod_base = OTHER; note = 2'-O-methyluridine
  modified_base 19: mod_base = OTHER; note = 2'-O-methyluridine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluoroguanosine
  modified_base 24: mod_base = OTHER; note = 2'-fluorouridine
  modified_base 25: mod_base = OTHER; note = 2'-O-methyladenosine
  modified_base 26: mod_base = OTHER; note = 2'-O-methylcytidine
  modified_base 27: mod_base = OTHER; note = 2'-O-methylcytidine
  modified_base 28: mod_base = OTHER; note = 2'-O-methyluridine
  modified_base 29: mod_base = OTHER; note = 2'-O-methylguanosine
  modified_base 30: mod_base = OTHER; note = 2'-O-methylcytidine
  modified_base 31: mod_base = OTHER; note = 2'-O-methyluridine
  modified_base 32: mod_base = OTHER; note = 2'-O-methylcytidine
  modified_base 33: mod_base = OTHER; note = 2'-O-methyladenosine
  modified_base 34: mod_base = OTHER; note = 2'-O-methyladenosine

SEQ ID NO: 891 - RNA, 34 nt, synthetic construct; identical to SEQ ID NO: 639
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methyluridine
  modified_base 4: mod_base = OTHER; note = 2'-O-methylguanosine
  modified_base 5: mod_base = OTHER; note = 2'-O-methyladenosine
  modified_base 6: mod_base = OTHER; note = 2'-O-methyluridine
  modified_base 7: mod_base = OTHER; note = 2'-O-methylguanosine
  modified_base 8: mod_base = OTHER; note = 2'-O-methyluridine
  modified_base 9: mod_base = OTHER; note = 2'-O-methyladenosine
  modified_base 10: mod_base = OTHER; note = 2'-O-methylguanosine
  modified_base 11: mod_base = OTHER; note = 2'-O-methyladenosine
  modified_base 12: mod_base = OTHER; note = 2'-O-methylcytidine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methylcytidine
  modified_base 16: mod_base = OTHER; note = 2'-O-methylcytidine
  modified_base 17: mod_base = OTHER; note = 2'-O-methyluridine
  modified_base 18: mod_base = OTHER; note = 2'-O-methyluridine
  modified_base 19: mod_base = OTHER; note = 2'-O-methylcytidine
  modified_base 20: mod_base = OTHER; note = 2'-O-methylguanosine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluoroguanosine
  modified_base 24: mod_base = OTHER; note = 2'-fluorouridine
  modified_base 25: mod_base = OTHER; note = 2'-O-methylcytidine
  modified_base 26: mod_base = OTHER; note = 2'-O-methyluridine
  modified_base 27: mod_base = OTHER; note = 2'-O-methyladenosine
  modified_base 28: mod_base = OTHER; note = 2'-O-methylcytidine
  modified_base 29: mod_base = OTHER; note = 2'-O-methyladenosine
  modified_base 30: mod_base = OTHER; note = 2'-O-methyluridine
  modified_base 31: mod_base = OTHER; note = 2'-O-methylcytidine
  modified_base 32: mod_base = OTHER; note = 2'-O-methyladenosine
  modified_base 33: mod_base = OTHER; note = 2'-O-methyladenosine
  modified_base 34: mod_base = OTHER; note = 2'-O-methyladenosine

SEQ ID NO: 892 - RNA, 34 nt, synthetic construct; identical to SEQ ID NO: 640
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methylguanosine
  modified_base 4: mod_base = OTHER; note = 2'-O-methylcytidine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methylguanosine
  modified_base 8: mod_base = OTHER; note = 2'-O-methyluridine
  modified_base 9: mod_base = OTHER; note = 2'-O-methylguanosine
  modified_base 10: mod_base = OTHER; note = 2'-O-methylguanosine
  modified_base 11: mod_base = OTHER; note = 2'-O-methyluridine
  modified_base 12: mod_base = OTHER; note = 2'-O-methyladenosine
  modified_base 13: mod_base = OTHER; note = 2'-O-methylguanosine
  modified_base 14: mod_base = OTHER; note = 2'-fluorouridine
  modified_base 15: mod_base = OTHER; note = 2'-O-methyluridine
  modified_base 16: mod_base = OTHER; note = 2'-O-methylguanosine
  modified_base 17: mod_base = OTHER; note = 2'-O-methylguanosine
  modified_base 18: mod_base = OTHER; note = 2'-O-methyladenosine
  modified_base 19: mod_base = OTHER; note = 2'-O-methylguanosine
  modified_base 20: mod_base = OTHER; note = 2'-O-methyladenosine
  modified_base 21: mod_base = OTHER; note = 2'-O-methyladenosine
  modified_base 22: mod_base = OTHER; note = 2'-fluorocytidine
  modified_base 23: mod_base = OTHER; note = 2'-fluorouridine
  modified_base 24: mod_base = OTHER; note = 2'-fluoroadenosine
  modified_base 25: mod_base = OTHER; note = 2'-O-methylcytidine
  modified_base 26: mod_base = OTHER; note = 2'-O-methylcytidine
  modified_base 27: mod_base = OTHER; note = 2'-O-methyladenosine
  modified_base 28: mod_base = OTHER; note = 2'-O-methylcytidine
  modified_base 29: mod_base = OTHER; note = 2'-O-methyluridine
  modified_base 30: mod_base = OTHER; note = 2'-O-methyluridine
  modified_base 31: mod_base = OTHER; note = 2'-O-methylguanosine
  modified_base 32: mod_base = OTHER; note = 2'-O-methylcytidine
  modified_base 33: mod_base = OTHER; note = 2'-O-methylcytidine
  modified_base 34: mod_base = OTHER; note = 2'-O-methyladenosine

SEQ ID NO: 893 - RNA, 34 nt, synthetic construct; identical to SEQ ID NO: 641
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methylguanosine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methylguanosine
  modified_base 7: mod_base = OTHER; note = 2'-O-methylcytidine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methylcytidine
  modified_base 11: mod_base = OTHER; note = 2'-O-methyladenosine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-fluoroguanosine
  modified_base 15: mod_base = OTHER; note = 2'-O-methylcytidine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methylguanosine
  modified_base 19: mod_base = OTHER; note = 2'-O-methyladenosine
  modified_base 20: mod_base = OTHER; note = 2'-O-methylguanosine
  modified_base 21: mod_base = OTHER; note = 2'-O-methylcytidine
  modified_base 22: mod_base = OTHER; note = 2'-fluorouridine
  modified_base 23: mod_base = OTHER; note = 2'-fluorouridine
  modified_base 24: mod_base = OTHER; note = 2'-fluorouridine
  modified_base 25: mod_base = OTHER; note = 2'-O-methylguanosine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methylguanosine
  modified_base 29: mod_base = OTHER; note = 2'-O-methylcytidine
  modified_base 30: mod_base = OTHER; note = 2'-O-methyluridine
  modified_base 31: mod_base = OTHER; note = 2'-O-methyluridine
  modified_base 32: mod_base = OTHER; note = 2'-O-methylcytidine
  modified_base 33: mod_base = OTHER; note = 2'-O-methylcytidine
  modified_base 34: mod_base = OTHER; note = 2'-O-methyladenosine

SEQ ID NO: 894 - RNA, 34 nt, synthetic construct; identical to SEQ ID NO: 642
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-O-methyluridine
  modified_base 5: mod_base = OTHER; note = 2'-O-methylguanosine
  modified_base 6: mod_base = OTHER; note = 2'-O-methyladenosine
  modified_base 7: mod_base = OTHER; note = 2'-O-methylcytidine
  modified_base 8: mod_base = OTHER; note = 2'-O-methyladenosine
  modified_base 9: mod_base = OTHER; note = 2'-O-methylguanosine
  modified_base 10: mod_base = OTHER; note = 2'-O-methyluridine
  modified_base 11: mod_base = OTHER; note = 2'-O-methyladenosine
  modified_base 12: mod_base = OTHER; note = 2'-O-methyladenosine
  modified_base 13: mod_base = OTHER; note = 2'-O-methyluridine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methylguanosine
  modified_base 17: mod_base = OTHER; note = 2'-O-methylguanosine
  modified_base 18: mod_base = OTHER; note = 2'-O-methyluridine
  modified_base 19: mod_base = OTHER; note = 2'-O-methylcytidine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluoroadenosine
  modified_base 23: mod_base = OTHER; note = 2'-fluorouridine
  modified_base 24: mod_base = OTHER; note = 2'-fluorouridine
  modified_base 25: mod_base = OTHER; note = 2'-O-methyladenosine
  modified_base 26: mod_base = OTHER; note = 2'-O-methylcytidine
  modified_base 27: mod_base = OTHER; note = 2'-O-methyluridine
  modified_base 28: mod_base = OTHER; note = 2'-O-methylguanosine
  modified_base 29: mod_base = OTHER; note = 2'-O-methyluridine
  modified_base 30: mod_base = OTHER; note = 2'-O-methylcytidine
  modified_base 31: mod_base = OTHER; note = 2'-O-methyladenosine
  modified_base 32: mod_base = OTHER; note = 2'-O-methyluridine
  modified_base 33: mod_base = OTHER; note = 2'-O-methyluridine
  modified_base 34: mod_base = OTHER; note = 2'-O-methyladenosine

SEQ ID NO: 895 - RNA, 34 nt, synthetic construct; identical to SEQ ID NO: 643
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methyluridine
  modified_base 4: mod_base = OTHER; note = 2'-O-methyluridine
  modified_base 5: mod_base = OTHER; note = 2'-O-methylguanosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methylcytidine
  modified_base 9: mod_base = OTHER; note = 2'-O-methyladenosine
  modified_base 10: mod_base = OTHER; note = 2'-O-methylcytidine
  modified_base 11: mod_base = OTHER; note = 2'-O-methyladenosine
  modified_base 12: mod_base = OTHER; note = 2'-O-methyluridine
  modified_base 13: mod_base = OTHER; note = 2'-O-methylguanosine
  modified_base 14: mod_base = OTHER; note = 2'-fluorouridine
  modified_base 15: mod_base = OTHER; note = 2'-O-methyluridine
  modified_base 16: mod_base = OTHER; note = 2'-O-methylguanosine
  modified_base 17: mod_base = OTHER; note = 2'-O-methylcytidine
  modified_base 18: mod_base = OTHER; note = 2'-O-methyluridine
  modified_base 19: mod_base = OTHER; note = 2'-O-methylcytidine
  modified_base 20: mod_base = OTHER; note = 2'-O-methyladenosine
  modified_base 21: mod_base = OTHER; note = 2'-O-methyladenosine
  modified_base 22: mod_base = OTHER; note = 2'-fluorocytidine
  modified_base 23: mod_base = OTHER; note = 2'-fluoroadenosine
  modified_base 24: mod_base = OTHER; note = 2'-fluorouridine
  modified_base 25: mod_base = OTHER; note = 2'-O-methylguanosine
  modified_base 26: mod_base = OTHER; note = 2'-O-methyluridine
  modified_base 27: mod_base = OTHER; note = 2'-O-methylguanosine
  modified_base 28: mod_base = OTHER; note = 2'-O-methyluridine
  modified_base 29: mod_base = OTHER; note = 2'-O-methyluridine
  modified_base 30: mod_base = OTHER; note = 2'-O-methylcytidine
  modified_base 31: mod_base = OTHER; note = 2'-O-methyladenosine
  modified_base 32: mod_base = OTHER; note = 2'-O-methyladenosine
  modified_base 33: mod_base = OTHER; note = 2'-O-methyladenosine
  modified_base 34: mod_base = OTHER; note = 2'-O-methyladenosine

SEQ ID NO: 896 - RNA, 34 nt, synthetic construct; identical to SEQ ID NO: 644
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methyluridine
  modified_base 6: mod_base = OTHER; note = 2'-O-methylcytidine
  modified_base 7: mod_base = OTHER; note = 2'-O-methylcytidine
  modified_base 8: mod_base = OTHER; note = 2'-O-methyluridine
  modified_base 9: mod_base = OTHER; note = 2'-O-methylcytidine
  modified_base 10: mod_base = OTHER; note = 2'-O-methyladenosine
  modified_base 11: mod_base = OTHER; note = 2'-O-methyluridine
  modified_base 12: mod_base = OTHER; note = 2'-O-methylcytidine
  modified_base 13: mod_base = OTHER; note = 2'-O-methyluridine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methylguanosine
  modified_base 17: mod_base = OTHER; note = 2'-O-methyladenosine
  modified_base 18: mod_base = OTHER; note = 2'-O-methylguanosine
  modified_base 19: mod_base = OTHER; note = 2'-O-methyluridine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluoroadenosine
  modified_base 23: mod_base = OTHER; note = 2'-fluoroguanosine
  modified_base 24: mod_base = OTHER; note = 2'-fluoroadenosine
  modified_base 25: mod_base = OTHER; note = 2'-O-methyluridine
  modified_base 26: mod_base = OTHER; note = 2'-O-methylguanosine
  modified_base 27: mod_base = OTHER; note = 2'-O-methyladenosine
  modified_base 28: mod_base = OTHER; note = 2'-O-methylguanosine
  modified_base 29: mod_base = OTHER; note = 2'-O-methylguanosine
  modified_base 30: mod_base = OTHER; note = 2'-O-methyladenosine
  modified_base 31: mod_base = OTHER; note = 2'-O-methyluridine
  modified_base 32: mod_base = OTHER; note = 2'-O-methyluridine
  modified_base 33: mod_base = OTHER; note = 2'-O-methyluridine
  modified_base 34: mod_base = OTHER; note = 2'-O-methyladenosine

SEQ ID NO: 897 - RNA, 34 nt, synthetic construct; identical to SEQ ID NO: 645
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methylguanosine
  modified_base 4: mod_base = OTHER; note = 2'-O-methyladenosine
  modified_base 5: mod_base = OTHER; note = 2'-O-methylguanosine
  modified_base 6: mod_base = OTHER; note = 2'-O-methyluridine
  modified_base 7: mod_base = OTHER; note = 2'-O-methyluridine
  modified_base 8: mod_base = OTHER; note = 2'-O-methyluridine
  modified_base 9: mod_base = OTHER; note = 2'-O-methylcytidine
  modified_base 10: mod_base = OTHER; note = 2'-O-methyluridine
  modified_base 11: mod_base = OTHER; note = 2'-O-methylcytidine
  modified_base 12: mod_base = OTHER; note = 2'-O-methylcytidine
  modified_base 13: mod_base = OTHER; note = 2'-O-methyluridine
  modified_base 14: mod_base = OTHER; note = 2'-fluorouridine
  modified_base 15: mod_base = OTHER; note = 2'-O-methylcytidine
  modified_base 16: mod_base = OTHER; note = 2'-O-methyladenosine
  modified_base 17: mod_base = OTHER; note = 2'-O-methylguanosine
  modified_base 18: mod_base = OTHER; note = 2'-O-methylcytidine
  modified_base 19: mod_base = OTHER; note = 2'-O-methylcytidine
  modified_base 20: mod_base = OTHER; note = 2'-O-methylguanosine
  modified_base 21: mod_base = OTHER; note = 2'-O-methyladenosine
  modified_base 22: mod_base = OTHER; note = 2'-fluoroadenosine
  modified_base 23: mod_base = OTHER; note = 2'-fluoroguanosine
  modified_base 24: mod_base = OTHER; note = 2'-fluoroguanosine
  modified_base 25: mod_base = OTHER; note = 2'-O-methyladenosine
  modified_base 26: mod_base = OTHER; note = 2'-O-methylguanosine
  modified_base 27: mod_base = OTHER; note = 2'-O-methyladenosine
  modified_base 28: mod_base = OTHER; note = 2'-O-methyladenosine
  modified_base 29: mod_base = OTHER; note = 2'-O-methyladenosine
  modified_base 30: mod_base = OTHER; note = 2'-O-methylcytidine
  modified_base 31: mod_base = OTHER; note = 2'-O-methyluridine
  modified_base 32: mod_base = OTHER; note = 2'-O-methylcytidine
  modified_base 33: mod_base = OTHER; note = 2'-O-methylcytidine
  modified_base 34: mod_base = OTHER; note = 2'-O-methyladenosine

SEQ ID NO: 898 - RNA, 34 nt, synthetic construct; identical to SEQ ID NO: 646
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methyluridine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methylcytidine
  modified_base 8: mod_base = OTHER; note = 2'-O-methyluridine
  modified_base 9: mod_base = OTHER; note = 2'-O-methyluridine
  modified_base 10: mod_base = OTHER; note = 2'-O-methylguanosine
  modified_base 11: mod_base = OTHER; note = 2'-O-methylcytidine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methylcytidine
  modified_base 16: mod_base = OTHER; note = 2'-O-methyluridine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methyluridine
  modified_base 20: mod_base = OTHER; note = 2'-O-methylguanosine
  modified_base 21: mod_base = OTHER; note = 2'-O-methylguanosine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluoroguanosine
  modified_base 25: mod_base = OTHER; note = 2'-O-methylcytidine
  modified_base 26: mod_base = OTHER; note = 2'-O-methyladenosine
  modified_base 27: mod_base = OTHER; note = 2'-O-methyladenosine
  modified_base 28: mod_base = OTHER; note = 2'-O-methylguanosine
  modified_base 29: mod_base = OTHER; note = 2'-O-methyluridine
  modified_base 30: mod_base = OTHER; note = 2'-O-methyluridine
  modified_base 31: mod_base = OTHER; note = 2'-O-methyladenosine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 899 - RNA, 34 nt, synthetic construct; identical to SEQ ID NO: 647
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methylcytidine
  modified_base 4: mod_base = OTHER; note = 2'-O-methyluridine
  modified_base 5: mod_base = OTHER; note = 2'-O-methylguanosine
  modified_base 6: mod_base = OTHER; note = 2'-O-methyluridine
  modified_base 7: mod_base = OTHER; note = 2'-O-methyluridine
  modified_base 8: mod_base = OTHER; note = 2'-O-methyluridine
  modified_base 9: mod_base = OTHER; note = 2'-O-methyluridine
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-O-methyluridine
  modified_base 13: mod_base = OTHER; note = 2'-O-methyluridine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methylcytidine
  modified_base 20: mod_base = OTHER; note = 2'-O-methyluridine
  modified_base 21: mod_base = OTHER; note = 2'-O-methylguanosine
  modified_base 22: mod_base = OTHER; note = 2'-fluoroadenosine
  modified_base 23: mod_base = OTHER; note = 2'-fluoroadenosine
  modified_base 24: mod_base = OTHER; note = 2'-fluorouridine
  modified_base 25: mod_base = OTHER; note = 2'-O-methyluridine
  modified_base 26: mod_base = OTHER; note = 2'-O-methyladenosine
  modified_base 27: mod_base = OTHER; note = 2'-O-methyladenosine
  modified_base 28: mod_base = OTHER; note = 2'-O-methyladenosine
  modified_base 29: mod_base = OTHER; note = 2'-O-methyladenosine
  modified_base 30: mod_base = OTHER; note = 2'-O-methylcytidine
  modified_base 31: mod_base = OTHER; note = 2'-O-methyladenosine
  modified_base 32: mod_base = OTHER; note = 2'-O-methylguanosine
  modified_base 33: mod_base = OTHER; note = 2'-O-methylcytidine
  modified_base 34: mod_base = OTHER; note = 2'-O-methyladenosine

SEQ ID NO: 900 - RNA, 34 nt, synthetic construct; identical to SEQ ID NO: 648
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-O-methylguanosine
  modified_base 5: mod_base = OTHER; note = 2'-O-methylcytidine
  modified_base 6: mod_base = OTHER; note = 2'-O-methyluridine
  modified_base 7: mod_base = OTHER; note = 2'-O-methylcytidine
  modified_base 8: mod_base = OTHER; note = 2'-O-methylguanosine
  modified_base 9: mod_base = OTHER; note = 2'-O-methyladenosine
  modified_base 10: mod_base = OTHER; note = 2'-O-methylguanosine
  modified_base 11: mod_base = OTHER; note = 2'-O-methyluridine
  modified_base 12: mod_base = OTHER; note = 2'-O-methyluridine
  modified_base 13: mod_base = OTHER; note = 2'-O-methylguanosine
  modified_base 14: mod_base = OTHER; note = 2'-fluorouridine
  modified_base 15: mod_base = OTHER; note = 2'-O-methyluridine
  modified_base 16: mod_base = OTHER; note = 2'-O-methylcytidine
  modified_base 17: mod_base = OTHER; note = 2'-O-methylcytidine
  modified_base 18: mod_base = OTHER; note = 2'-O-methylcytidine
  modified_base 19: mod_base = OTHER; note = 2'-O-methyluridine
  modified_base 20: mod_base = OTHER; note = 2'-O-methyladenosine
  modified_base 21: mod_base = OTHER; note = 2'-O-methyladenosine
  modified_base 22: mod_base = OTHER; note = 2'-fluorocytidine
  modified_base 23: mod_base = OTHER; note = 2'-fluoroadenosine
  modified_base 24: mod_base = OTHER; note = 2'-fluoroadenosine
  modified_base 25: mod_base = OTHER; note = 2'-O-methylcytidine
  modified_base 26: mod_base = OTHER; note = 2'-O-methyluridine
  modified_base 27: mod_base = OTHER; note = 2'-O-methylcytidine
  modified_base 28: mod_base = OTHER; note = 2'-O-methylguanosine
  modified_base 29: mod_base = OTHER; note = 2'-O-methyladenosine
  modified_base 30: mod_base = OTHER; note = 2'-O-methylguanosine
  modified_base 31: mod_base = OTHER; note = 2'-O-methylcytidine
  modified_base 32: mod_base = OTHER; note = 2'-O-methyluridine
  modified_base 33: mod_base = OTHER; note = 2'-O-methyluridine
  modified_base 34: mod_base = OTHER; note = 2'-O-methyladenosine

SEQ ID NO: 901 - RNA, 34 nt, synthetic construct; identical to SEQ ID NO: 649
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methylguanosine
  modified_base 4: mod_base = OTHER; note = 2'-O-methylcytidine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methylcytidine
  modified_base 8: mod_base = OTHER; note = 2'-O-methylguanosine
  modified_base 9: mod_base = OTHER; note = 2'-O-methyluridine
  modified_base 10: mod_base = OTHER; note = 2'-O-methylcytidine
  modified_base 11: mod_base = OTHER; note = 2'-O-methyladenosine
  modified_base 12: mod_base = OTHER; note = 2'-O-methyluridine
  modified_base 13: mod_base = OTHER; note = 2'-O-methyladenosine
  modified_base 14: mod_base = OTHER; note = 2'-fluoroguanosine
  modified_base 15: mod_base = OTHER; note = 2'-O-methyluridine
  modified_base 16: mod_base = OTHER; note = 2'-O-methylcytidine
  modified_base 17: mod_base = OTHER; note = 2'-O-methyladenosine
  modified_base 18: mod_base = OTHER; note = 2'-O-methyluridine
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methylcytidine
  modified_base 22: mod_base = OTHER; note = 2'-fluorouridine
  modified_base 23: mod_base = OTHER; note = 2'-fluoroadenosine
  modified_base 24: mod_base = OTHER; note = 2'-fluorouridine
  modified_base 25: mod_base = OTHER; note = 2'-O-methylguanosine
  modified_base 26: mod_base = OTHER; note = 2'-O-methyladenosine
  modified_base 27: mod_base = OTHER; note = 2'-O-methylcytidine
  modified_base 28: mod_base = OTHER; note = 2'-O-methylguanosine
  modified_base 29: mod_base = OTHER; note = 2'-O-methyluridine
  modified_base 30: mod_base = OTHER; note = 2'-O-methyluridine
  modified_base 31: mod_base = OTHER; note = 2'-O-methylguanosine
  modified_base 32: mod_base = OTHER; note = 2'-O-methylcytidine
  modified_base 33: mod_base = OTHER; note = 2'-O-methylcytidine
  modified_base 34: mod_base = OTHER; note = 2'-O-methyladenosine

SEQ ID NO: 902 - RNA, 34 nt, synthetic construct; identical to SEQ ID NO: 650
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methyluridine
  modified_base 4: mod_base = OTHER; note = 2'-O-methylcytidine
  modified_base 5: mod_base = OTHER; note = 2'-O-methylcytidine
  modified_base 6: mod_base = OTHER; note = 2'-O-methyladenosine
  modified_base 7: mod_base = OTHER; note = 2'-O-methylguanosine
  modified_base 8: mod_base = OTHER; note = 2'-O-methylguanosine
  modified_base 9: mod_base = OTHER; note = 2'-O-methyluridine
  modified_base 10: mod_base = OTHER; note = 2'-O-methyluridine
  modified_base 11: mod_base = OTHER; note = 2'-O-methyluridine
  modified_base 12: mod_base = OTHER; note = 2'-O-methyluridine
  modified_base 13: mod_base = OTHER; note = 2'-O-methylcytidine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-O-methyluridine
  modified_base 17: mod_base = OTHER; note = 2'-O-methyladenosine
  modified_base 18: mod_base = OTHER; note = 2'-O-methyluridine
  modified_base 19: mod_base = OTHER; note = 2'-O-methylcytidine
  modified_base 20: mod_base = OTHER; note = 2'-O-methyluridine
  modified_base 21: mod_base = OTHER; note = 2'-O-methylguanosine
  modified_base 22: mod_base = OTHER; note = 2'-fluoroguanosine
  modified_base 23: mod_base = OTHER; note = 2'-fluoroadenosine
  modified_base 24: mod_base = OTHER; note = 2'-fluoroadenosine
  modified_base 25: mod_base = OTHER; note = 2'-O-methyladenosine
  modified_base 26: mod_base = OTHER; note = 2'-O-methyladenosine
  modified_base 27: mod_base = OTHER; note = 2'-O-methylcytidine
  modified_base 28: mod_base = OTHER; note = 2'-O-methylcytidine
  modified_base 29: mod_base = OTHER; note = 2'-O-methyluridine
  modified_base 30: mod_base = OTHER; note = 2'-O-methylguanosine
  modified_base 31: mod_base = OTHER; note = 2'-O-methylguanosine
  modified_base 32: mod_base = OTHER; note = 2'-O-methyladenosine
  modified_base 33: mod_base = OTHER; note = 2'-O-methyladenosine
  modified_base 34: mod_base = OTHER; note = 2'-O-methyladenosine

SEQ ID NO: 903 - RNA, 34 nt, synthetic construct; identical to SEQ ID NO: 651
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylcytidine
  modified_base 4: mod_base = OTHER; note = 2'-O-methylcytidine
  modified_base 5: mod_base = OTHER; note = 2'-O-methyladenosine
  modified_base 6: mod_base = OTHER; note = 2'-O-methylguanosine
  modified_base 7: mod_base = OTHER; note = 2'-O-methylguanosine
  modified_base 8: mod_base = OTHER; note = 2'-O-methyluridine
  modified_base 9: mod_base = OTHER; note = 2'-O-methyluridine
  modified_base 10: mod_base = OTHER; note = 2'-O-methyluridine
  modified_base 11: mod_base = OTHER; note = 2'-O-methyluridine
  modified_base 12: mod_base = OTHER; note = 2'-O-methylcytidine
  modified_base 13: mod_base = OTHER; note = 2'-O-methylcytidine
  modified_base 14: mod_base = OTHER; note = 2'-fluoroadenosine
  modified_base 15: mod_base = OTHER; note = 2'-O-methyluridine
  modified_base 16: mod_base = OTHER; note = 2'-O-methyladenosine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methylcytidine
  modified_base 20: mod_base = OTHER; note = 2'-O-methyladenosine
  modified_base 21: mod_base = OTHER; note = 2'-O-methyluridine
  modified_base 22: mod_base = OTHER; note = 2'-fluoroguanosine
  modified_base 23: mod_base = OTHER; note = 2'-fluoroguanosine
  modified_base 24: mod_base = OTHER; note = 2'-fluoroadenosine
  modified_base 25: mod_base = OTHER; note = 2'-O-methyladenosine
  modified_base 26: mod_base = OTHER; note = 2'-O-methyladenosine
  modified_base 27: mod_base = OTHER; note = 2'-O-methyladenosine
  modified_base 28: mod_base = OTHER; note = 2'-O-methylcytidine
  modified_base 29: mod_base = OTHER; note = 2'-O-methylcytidine
  modified_base 30: mod_base = OTHER; note = 2'-O-methyluridine
  modified_base 31: mod_base = OTHER; note = 2'-O-methylguanosine
  modified_base 32: mod_base = OTHER; note = 2'-O-methylguanosine
  modified_base 33: mod_base = OTHER; note = 2'-O-methyladenosine
  modified_base 34: mod_base = OTHER; note = 2'-O-methyladenosine

SEQ ID NO: 904 - RNA, 34 nt, synthetic construct; identical to SEQ ID NO: 652
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methylcytidine
  modified_base 4: mod_base = OTHER; note = 2'-O-methyladenosine
  modified_base 5: mod_base = OTHER; note = 2'-O-methyluridine
  modified_base 6: mod_base = OTHER; note = 2'-O-methylguanosine
  modified_base 7: mod_base = OTHER; note = 2'-O-methyluridine
  modified_base 8: mod_base = OTHER; note = 2'-O-methyluridine
  modified_base 9: mod_base = OTHER; note = 2'-O-methylguanosine
  modified_base 10: mod_base = OTHER; note = 2'-O-methyluridine
  modified_base 11: mod_base = OTHER; note = 2'-O-methylguanosine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyluridine
  modified_base 16: mod_base = OTHER; note = 2'-O-methylcytidine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methyluridine
  modified_base 20: mod_base = OTHER; note = 2'-O-methyladenosine
  modified_base 21: mod_base = OTHER; note = 2'-O-methyluridine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluorocytidine
  modified_base 25: mod_base = OTHER; note = 2'-O-methyladenosine
  modified_base 26: mod_base = OTHER; note = 2'-O-methylcytidine
  modified_base 27: mod_base = OTHER; note = 2'-O-methyladenosine
  modified_base 28: mod_base = OTHER; note = 2'-O-methyladenosine
  modified_base 29: mod_base = OTHER; note = 2'-O-methylcytidine
  modified_base 30: mod_base = OTHER; note = 2'-O-methyladenosine
  modified_base 31: mod_base = OTHER; note = 2'-O-methyluridine
  modified_base 32: mod_base = OTHER; note = 2'-O-methylguanosine
  modified_base 33: mod_base = OTHER; note = 2'-O-methylguanosine
  modified_base 34: mod_base = OTHER; note = 2'-O-methyladenosine

SEQ ID NO: 905 - RNA, 34 nt, synthetic construct; identical to SEQ ID NO: 653
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methyluridine
  modified_base 5: mod_base = OTHER; note = 2'-O-methyladenosine
  modified_base 6: mod_base = OTHER; note = 2'-O-methyluridine
  modified_base 7: mod_base = OTHER; note = 2'-O-methylcytidine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methyluridine
  modified_base 11: mod_base = OTHER; note = 2'-O-methylguanosine
  modified_base 12: mod_base = OTHER; note = 2'-O-methyladenosine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methyluridine
  modified_base 16: mod_base = OTHER; note = 2'-O-methyluridine
  modified_base 17: mod_base = OTHER; note = 2'-O-methylguanosine
  modified_base 18: mod_base = OTHER; note = 2'-O-methyladenosine
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluorouridine
  modified_base 24: mod_base = OTHER; note = 2'-fluorocytidine
  modified_base 25: mod_base = OTHER; note = 2'-O-methyladenosine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methylguanosine
  modified_base 29: mod_base = OTHER; note = 2'-O-methyladenosine
  modified_base 30: mod_base = OTHER; note = 2'-O-methyluridine
  modified_base 31: mod_base = OTHER; note = 2'-O-methyladenosine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 906 - RNA, 34 nt, synthetic construct; identical to SEQ ID NO: 654
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylguanosine
  modified_base 4: mod_base = OTHER; note = 2'-O-methyladenosine
  modified_base 5: mod_base = OTHER; note = 2'-O-methylcytidine
  modified_base 6: mod_base = OTHER; note = 2'-O-methyluridine
  modified_base 7: mod_base = OTHER; note = 2'-O-methyluridine
  modified_base 8: mod_base = OTHER; note = 2'-O-methyluridine
  modified_base 9: mod_base = OTHER; note = 2'-O-methylguanosine
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-O-methyluridine
  modified_base 17: mod_base = OTHER; note = 2'-O-methylguanosine
  modified_base 18: mod_base = OTHER; note = 2'-O-methyluridine
  modified_base 19: mod_base = OTHER; note = 2'-O-methyluridine
  modified_base 20: mod_base = OTHER; note = 2'-O-methyluridine
  modified_base 21: mod_base = OTHER; note = 2'-O-methylguanosine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluorouridine
  modified_base 25: mod_base = OTHER; note = 2'-O-methyluridine
  modified_base 26: mod_base = OTHER; note = 2'-O-methylcytidine
  modified_base 27: mod_base = OTHER; note = 2'-O-methyladenosine
  modified_base 28: mod_base = OTHER; note = 2'-O-methyladenosine
  modified_base 29: mod_base = OTHER; note = 2'-O-methyladenosine
  modified_base 30: mod_base = OTHER; note = 2'-O-methylguanosine
  modified_base 31: mod_base = OTHER; note = 2'-O-methyluridine
  modified_base 32: mod_base = OTHER; note = 2'-O-methylcytidine
  modified_base 33: mod_base = OTHER; note = 2'-O-methyladenosine
  modified_base 34: mod_base = OTHER; note = 2'-O-methyladenosine

SEQ ID NO: 907 - RNA, 34 nt, synthetic construct; identical to SEQ ID NO: 655
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyluridine
  modified_base 4: mod_base = OTHER; note = 2'-O-methylcytidine
  modified_base 5: mod_base = OTHER; note = 2'-O-methyladenosine
  modified_base 6: mod_base = OTHER; note = 2'-O-methyluridine
  modified_base 7: mod_base = OTHER; note = 2'-O-methylcytidine
  modified_base 8: mod_base = OTHER; note = 2'-O-methyluridine
  modified_base 9: mod_base = OTHER; note = 2'-O-methyluridine
  modified_base 10: mod_base = OTHER; note = 2'-O-methylguanosine
  modified_base 11: mod_base = OTHER; note = 2'-O-methylguanosine
  modified_base 12: mod_base = OTHER; note = 2'-O-methyladenosine
  modified_base 13: mod_base = OTHER; note = 2'-O-methylguanosine
  modified_base 14: mod_base = OTHER; note = 2'-fluorouridine
  modified_base 15: mod_base = OTHER; note = 2'-O-methyluridine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methyluridine
  modified_base 19: mod_base = OTHER; note = 2'-O-methylcytidine
  modified_base 20: mod_base = OTHER; note = 2'-O-methyladenosine
  modified_base 21: mod_base = OTHER; note = 2'-O-methyladenosine
  modified_base 22: mod_base = OTHER; note = 2'-fluorocytidine
  modified_base 23: mod_base = OTHER; note = 2'-fluorouridine
  modified_base 24: mod_base = OTHER; note = 2'-fluorocytidine
  modified_base 25: mod_base = OTHER; note = 2'-O-methylcytidine
  modified_base 26: mod_base = OTHER; note = 2'-O-methyladenosine
  modified_base 27: mod_base = OTHER; note = 2'-O-methyladenosine
  modified_base 28: mod_base = OTHER; note = 2'-O-methylguanosine
  modified_base 29: mod_base = OTHER; note = 2'-O-methyladenosine
  modified_base 30: mod_base = OTHER; note = 2'-O-methyluridine
  modified_base 31: mod_base = OTHER; note = 2'-O-methylguanosine
  modified_base 32: mod_base = OTHER; note = 2'-O-methyladenosine
  modified_base 33: mod_base = OTHER; note = 2'-O-methylguanosine
  modified_base 34: mod_base = OTHER; note = 2'-O-methyladenosine

SEQ ID NO: 908 - RNA, 34 nt, synthetic construct; identical to SEQ ID NO: 656
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methyluridine
  modified_base 5: mod_base = OTHER; note = 2'-O-methylguanosine
  modified_base 6: mod_base = OTHER; note = 2'-O-methyluridine
  modified_base 7: mod_base = OTHER; note = 2'-O-methyluridine
  modified_base 8: mod_base = OTHER; note = 2'-O-methylguanosine
  modified_base 9: mod_base = OTHER; note = 2'-O-methylcytidine
  modified_base 10: mod_base = OTHER; note = 2'-O-methyluridine
  modified_base 11: mod_base = OTHER; note = 2'-O-methylcytidine
  modified_base 12: mod_base = OTHER; note = 2'-O-methyladenosine
  modified_base 13: mod_base = OTHER; note = 2'-O-methyluridine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methyluridine
  modified_base 19: mod_base = OTHER; note = 2'-O-methyluridine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluoroadenosine
  modified_base 23: mod_base = OTHER; note = 2'-fluorouridine
  modified_base 24: mod_base = OTHER; note = 2'-fluoroguanosine
  modified_base 25: mod_base = OTHER; note = 2'-O-methyladenosine
  modified_base 26: mod_base = OTHER; note = 2'-O-methylguanosine
  modified_base 27: mod_base = OTHER; note = 2'-O-methylcytidine
  modified_base 28: mod_base = OTHER; note = 2'-O-methyladenosine
  modified_base 29: mod_base = OTHER; note = 2'-O-methyladenosine
  modified_base 30: mod_base = OTHER; note = 2'-O-methylcytidine
  modified_base 31: mod_base = OTHER; note = 2'-O-methyladenosine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 909 - RNA, 34 nt, synthetic construct; identical to SEQ ID NO: 657
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylcytidine
  modified_base 4: mod_base = OTHER; note = 2'-O-methylcytidine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methylcytidine
  modified_base 8: mod_base = OTHER; note = 2'-O-methyluridine
  modified_base 9: mod_base = OTHER; note = 2'-O-methyluridine
  modified_base 10: mod_base = OTHER; note = 2'-O-methylguanosine
  modified_base 11: mod_base = OTHER; note = 2'-O-methyladenosine
  modified_base 12: mod_base = OTHER; note = 2'-O-methyladenosine
  modified_base 13: mod_base = OTHER; note = 2'-O-methyluridine
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methylcytidine
  modified_base 19: mod_base = OTHER; note = 2'-O-methylguanosine
  modified_base 20: mod_base = OTHER; note = 2'-O-methyluridine
  modified_base 21: mod_base = OTHER; note = 2'-O-methylcytidine
  modified_base 22: mod_base = OTHER; note = 2'-fluoroadenosine
  modified_base 23: mod_base = OTHER; note = 2'-fluorouridine
  modified_base 24: mod_base = OTHER; note = 2'-fluorouridine
  modified_base 25: mod_base = OTHER; note = 2'-O-methylcytidine
  modified_base 26: mod_base = OTHER; note = 2'-O-methyladenosine
  modified_base 27: mod_base = OTHER; note = 2'-O-methyladenosine
  modified_base 28: mod_base = OTHER; note = 2'-O-methylguanosine
  modified_base 29: mod_base = OTHER; note = 2'-O-methyluridine
  modified_base 30: mod_base = OTHER; note = 2'-O-methyluridine
  modified_base 31: mod_base = OTHER; note = 2'-O-methylguanosine
  modified_base 32: mod_base = OTHER; note = 2'-O-methylguanosine
  modified_base 33: mod_base = OTHER; note = 2'-O-methyluridine
  modified_base 34: mod_base = OTHER; note = 2'-O-methyladenosine

SEQ ID NO: 910 - RNA, 34 nt, synthetic construct; identical to SEQ ID NO: 658
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylcytidine
  modified_base 4: mod_base = OTHER; note = 2'-O-methyladenosine
  modified_base 5: mod_base = OTHER; note = 2'-O-methylguanosine
  modified_base 6: mod_base = OTHER; note = 2'-O-methyladenosine
  modified_base 7: mod_base = OTHER; note = 2'-O-methyluridine
  modified_base 8: mod_base = OTHER; note = 2'-O-methylcytidine
  modified_base 9: mod_base = OTHER; note = 2'-O-methylguanosine
  modified_base 10: mod_base = OTHER; note = 2'-O-methylcytidine
  modified_base 11: mod_base = OTHER; note = 2'-O-methyluridine
  modified_base 12: mod_base = OTHER; note = 2'-O-methylguanosine
  modified_base 13: mod_base = OTHER; note = 2'-O-methyluridine
  modified_base 14: mod_base = OTHER; note = 2'-fluorocytidine
  modified_base 15: mod_base = OTHER; note = 2'-O-methyluridine
  modified_base 16: mod_base = OTHER; note = 2'-O-methylguanosine
  modified_base 17: mod_base = OTHER; note = 2'-O-methylcytidine
  modified_base 18: mod_base = OTHER; note = 2'-O-methylcytidine
  modified_base 19: mod_base = OTHER; note = 2'-O-methylcytidine
  modified_base 20: mod_base = OTHER; note = 2'-O-methyladenosine
  modified_base 21: mod_base = OTHER; note = 2'-O-methylguanosine
  modified_base 22: mod_base = OTHER; note = 2'-fluoroadenosine
  modified_base 23: mod_base = OTHER; note = 2'-fluorocytidine
  modified_base 24: mod_base = OTHER; note = 2'-fluoroadenosine
  modified_base 25: mod_base = OTHER; note = 2'-O-methylguanosine
  modified_base 26: mod_base = OTHER; note = 2'-O-methylcytidine
  modified_base 27: mod_base = OTHER; note = 2'-O-methylguanosine
  modified_base 28: mod_base = OTHER; note = 2'-O-methyladenosine
  modified_base 29: mod_base = OTHER; note = 2'-O-methyluridine
  modified_base 30: mod_base = OTHER; note = 2'-O-methylcytidine
  modified_base 31: mod_base = OTHER; note = 2'-O-methyluridine
  modified_base 32: mod_base = OTHER; note = 2'-O-methylguanosine
  modified_base 33: mod_base = OTHER; note = 2'-O-methyluridine
  modified_base 34: mod_base = OTHER; note = 2'-O-methyladenosine

SEQ ID NO: 911 - RNA, 34 nt, synthetic construct; identical to SEQ ID NO: 659
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylcytidine
  modified_base 4: mod_base = OTHER; note = 2'-O-methyladenosine
  modified_base 5: mod_base = OTHER; note = 2'-O-methylcytidine
  modified_base 6: mod_base = OTHER; note = 2'-O-methyladenosine
  modified_base 7: mod_base = OTHER; note = 2'-O-methylguanosine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methylguanosine
  modified_base 11: mod_base = OTHER; note = 2'-O-methylcytidine
  modified_base 12: mod_base = OTHER; note = 2'-O-methylcytidine
  modified_base 13: mod_base = OTHER; note = 2'-O-methyluridine
  modified_base 14: mod_base = OTHER; note = 2'-fluorouridine
  modified_base 15: mod_base = OTHER; note = 2'-O-methyluridine
  modified_base 16: mod_base = OTHER; note = 2'-O-methylcytidine
  modified_base 17: mod_base = OTHER; note = 2'-O-methyluridine
  modified_base 18: mod_base = OTHER; note = 2'-O-methyluridine
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  modified_base 22: mod_base = OTHER; note = 2'-fluoroadenosine
  modified_base 23: mod_base = OTHER; note = 2'-fluoroguanosine
  modified_base 24: mod_base = OTHER; note = 2'-fluoroguanosine
  modified_base 25: mod_base = OTHER; note = 2'-O-methylcytidine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methylcytidine
  modified_base 29: mod_base = OTHER; note = 2'-O-methyluridine
  modified_base 30: mod_base = OTHER; note = 2'-O-methylguanosine
  modified_base 31: mod_base = OTHER; note = 2'-O-methyluridine
  modified_base 32: mod_base = OTHER; note = 2'-O-methylguanosine
  modified_base 33: mod_base = OTHER; note = 2'-O-methyladenosine
  modified_base 34: mod_base = OTHER; note = 2'-O-methyladenosine

SEQ ID NO: 912 - RNA, 34 nt, synthetic construct; identical to SEQ ID NO: 660
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methylguanosine
  modified_base 4: mod_base = OTHER; note = 2'-O-methylcytidine
  modified_base 5: mod_base = OTHER; note = 2'-O-methylcytidine
  modified_base 6: mod_base = OTHER; note = 2'-O-methylguanosine
  modified_base 7: mod_base = OTHER; note = 2'-O-methylcytidine
  modified_base 8: mod_base = OTHER; note = 2'-O-methylcytidine
  modified_base 9: mod_base = OTHER; note = 2'-O-methyladenosine
  modified_base 10: mod_base = OTHER; note = 2'-O-methylguanosine
  modified_base 11: mod_base = OTHER; note = 2'-O-methyladenosine
  modified_base 12: mod_base = OTHER; note = 2'-O-methyladenosine
  modified_base 13: mod_base = OTHER; note = 2'-O-methyluridine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-O-methylcytidine
  modified_base 17: mod_base = OTHER; note = 2'-O-methylcytidine
  modified_base 18: mod_base = OTHER; note = 2'-O-methyluridine
  modified_base 19: mod_base = OTHER; note = 2'-O-methylcytidine
  modified_base 20: mod_base = OTHER; note = 2'-O-methyluridine
  modified_base 21: mod_base = OTHER; note = 2'-O-methylguanosine
  modified_base 22: mod_base = OTHER; note = 2'-fluoroadenosine
  modified_base 23: mod_base = OTHER; note = 2'-fluorouridine
  modified_base 24: mod_base = OTHER; note = 2'-fluorouridine
  modified_base 25: mod_base = OTHER; note = 2'-O-methylcytidine
  modified_base 26: mod_base = OTHER; note = 2'-O-methyluridine
  modified_base 27: mod_base = OTHER; note = 2'-O-methylguanosine
  modified_base 28: mod_base = OTHER; note = 2'-O-methylguanosine
  modified_base 29: mod_base = OTHER; note = 2'-O-methylcytidine
  modified_base 30: mod_base = OTHER; note = 2'-O-methylguanosine
  modified_base 31: mod_base = OTHER; note = 2'-O-methylguanosine
  modified_base 32: mod_base = OTHER; note = 2'-O-methylcytidine
  modified_base 33: mod_base = OTHER; note = 2'-O-methylcytidine
  modified_base 34: mod_base = OTHER; note = 2'-O-methyladenosine

SEQ ID NO: 913 - RNA, 34 nt, synthetic construct; identical to SEQ ID NO: 661
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methylcytidine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methylguanosine
  modified_base 7: mod_base = OTHER; note = 2'-O-methylcytidine
  modified_base 8: mod_base = OTHER; note = 2'-O-methyluridine
  modified_base 9: mod_base = OTHER; note = 2'-O-methylguanosine
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-O-methyladenosine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methylcytidine
  modified_base 16: mod_base = OTHER; note = 2'-O-methylcytidine
  modified_base 17: mod_base = OTHER; note = 2'-O-methyladenosine
  modified_base 18: mod_base = OTHER; note = 2'-O-methylguanosine
  modified_base 19: mod_base = OTHER; note = 2'-O-methyladenosine
  modified_base 20: mod_base = OTHER; note = 2'-O-methylguanosine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluorouridine
  modified_base 24: mod_base = OTHER; note = 2'-fluorouridine
  modified_base 25: mod_base = OTHER; note = 2'-O-methyluridine
  modified_base 26: mod_base = OTHER; note = 2'-O-methylcytidine
  modified_base 27: mod_base = OTHER; note = 2'-O-methyladenosine
  modified_base 28: mod_base = OTHER; note = 2'-O-methylguanosine
  modified_base 29: mod_base = OTHER; note = 2'-O-methylcytidine
  modified_base 30: mod_base = OTHER; note = 2'-O-methyluridine
  modified_base 31: mod_base = OTHER; note = 2'-O-methyluridine
  modified_base 32: mod_base = OTHER; note = 2'-O-methylguanosine
  modified_base 33: mod_base = OTHER; note = 2'-O-methylguanosine
  modified_base 34: mod_base = OTHER; note = 2'-O-methyladenosine

SEQ ID NO: 914 - RNA, 34 nt, synthetic construct; identical to SEQ ID NO: 662
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methyluridine
  modified_base 4: mod_base = OTHER; note = 2'-O-methylguanosine
  modified_base 5: mod_base = OTHER; note = 2'-O-methyladenosine
  modified_base 6: mod_base = OTHER; note = 2'-O-methyluridine
  modified_base 7: mod_base = OTHER; note = 2'-O-methylcytidine
  modified_base 8: mod_base = OTHER; note = 2'-O-methyladenosine
  modified_base 9: mod_base = OTHER; note = 2'-O-methylguanosine
  modified_base 10: mod_base = OTHER; note = 2'-O-methylguanosine
  modified_base 11: mod_base = OTHER; note = 2'-O-methylguanosine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methylcytidine
  modified_base 16: mod_base = OTHER; note = 2'-O-methylguanosine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methyladenosine
  modified_base 20: mod_base = OTHER; note = 2'-O-methylguanosine
  modified_base 21: mod_base = OTHER; note = 2'-O-methyluridine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluorocytidine
  modified_base 25: mod_base = OTHER; note = 2'-O-methylcytidine
  modified_base 26: mod_base = OTHER; note = 2'-O-methylcytidine
  modified_base 27: mod_base = OTHER; note = 2'-O-methyluridine
  modified_base 28: mod_base = OTHER; note = 2'-O-methylguanosine
  modified_base 29: mod_base = OTHER; note = 2'-O-methyladenosine
  modified_base 30: mod_base = OTHER; note = 2'-O-methyluridine
  modified_base 31: mod_base = OTHER; note = 2'-O-methylcytidine
  modified_base 32: mod_base = OTHER; note = 2'-O-methyladenosine
  modified_base 33: mod_base = OTHER; note = 2'-O-methyladenosine
  modified_base 34: mod_base = OTHER; note = 2'-O-methyladenosine

SEQ ID NO: 915 - RNA, 34 nt, synthetic construct; identical to SEQ ID NO: 663
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methyluridine
  modified_base 4: mod_base = OTHER; note = 2'-O-methyluridine
  modified_base 5: mod_base = OTHER; note = 2'-O-methylcytidine
  modified_base 6: mod_base = OTHER; note = 2'-O-methylcytidine
  modified_base 7: mod_base = OTHER; note = 2'-O-methylcytidine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = OTHER; note = 2'-O-methylcytidine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methylcytidine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methylcytidine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluoroguanosine
  modified_base 25: mod_base = OTHER; note = 2'-O-methyluridine
  modified_base 26: mod_base = OTHER; note = 2'-O-methyluridine
  modified_base 27: mod_base = OTHER; note = 2'-O-methyluridine
  modified_base 28: mod_base = OTHER; note = 2'-O-methylguanosine
  modified_base 29: mod_base = OTHER; note = 2'-O-methylguanosine
  modified_base 30: mod_base = OTHER; note = 2'-O-methylguanosine
  modified_base 31: mod_base = OTHER; note = 2'-O-methyladenosine
  modified_base 32: mod_base = OTHER; note = 2'-O-methyladenosine
  modified_base 33: mod_base = OTHER; note = 2'-O-methylcytidine
  modified_base 34: mod_base = OTHER; note = 2'-O-methyladenosine

SEQ ID NO: 916 - RNA, 34 nt, synthetic construct; identical to SEQ ID NO: 664
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylcytidine
  modified_base 4: mod_base = OTHER; note = 2'-O-methylcytidine
  modified_base 5: mod_base = OTHER; note = 2'-O-methyluridine
  modified_base 6: mod_base = OTHER; note = 2'-O-methylguanosine
  modified_base 7: mod_base = OTHER; note = 2'-O-methylcytidine
  modified_base 8: mod_base = OTHER; note = 2'-O-methyluridine
  modified_base 9: mod_base = OTHER; note = 2'-O-methyluridine
  modified_base 10: mod_base = OTHER; note = 2'-O-methyluridine
  modified_base 11: mod_base = OTHER; note = 2'-O-methyluridine
  modified_base 12: mod_base = OTHER; note = 2'-O-methylguanosine
  modified_base 13: mod_base = OTHER; note = 2'-O-methylcytidine
  modified_base 14: mod_base = OTHER; note = 2'-fluorocytidine
  modified_base 15: mod_base = OTHER; note = 2'-O-methylguanosine
  modified_base 16: mod_base = OTHER; note = 2'-O-methylcytidine
  modified_base 17: mod_base = OTHER; note = 2'-O-methyluridine
  modified_base 18: mod_base = OTHER; note = 2'-O-methyluridine
  modified_base 19: mod_base = OTHER; note = 2'-O-methylcytidine
  modified_base 20: mod_base = OTHER; note = 2'-O-methylcytidine
  modified_base 21: mod_base = OTHER; note = 2'-O-methylguanosine
  modified_base 22: mod_base = OTHER; note = 2'-fluoroguanosine
  modified_base 23: mod_base = OTHER; note = 2'-fluorocytidine
  modified_base 24: mod_base = OTHER; note = 2'-fluoroadenosine
  modified_base 25: mod_base = OTHER; note = 2'-O-methyladenosine
  modified_base 26: mod_base = OTHER; note = 2'-O-methyladenosine
  modified_base 27: mod_base = OTHER; note = 2'-O-methyladenosine
  modified_base 28: mod_base = OTHER; note = 2'-O-methylguanosine
  modified_base 29: mod_base = OTHER; note = 2'-O-methylcytidine
  modified_base 30: mod_base = OTHER; note = 2'-O-methyladenosine
  modified_base 31: mod_base = OTHER; note = 2'-O-methylguanosine
  modified_base 32: mod_base = OTHER; note = 2'-O-methylguanosine
  modified_base 33: mod_base = OTHER; note = 2'-O-methyluridine
  modified_base 34: mod_base = OTHER; note = 2'-O-methyladenosine

SEQ ID NO: 917 - RNA, 34 nt, synthetic construct; identical to SEQ ID NO: 665
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methyluridine
  modified_base 4: mod_base = OTHER; note = 2'-O-methylguanosine
  modified_base 5: mod_base = OTHER; note = 2'-O-methylcytidine
  modified_base 6: mod_base = OTHER; note = 2'-O-methyluridine
  modified_base 7: mod_base = OTHER; note = 2'-O-methylcytidine
  modified_base 8: mod_base = OTHER; note = 2'-O-methyladenosine
  modified_base 9: mod_base = OTHER; note = 2'-O-methyluridine
  modified_base 10: mod_base = OTHER; note = 2'-O-methyluridine
  modified_base 11: mod_base = OTHER; note = 2'-O-methylguanosine
  modified_base 12: mod_base = OTHER; note = 2'-O-methyluridine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methyluridine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methyluridine
  modified_base 19: mod_base = OTHER; note = 2'-O-methyluridine
  modified_base 20: mod_base = OTHER; note = 2'-O-methyladenosine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluoroadenosine
  modified_base 24: mod_base = OTHER; note = 2'-fluorocytidine
  modified_base 25: mod_base = OTHER; note = 2'-O-methyladenosine
  modified_base 26: mod_base = OTHER; note = 2'-O-methyladenosine
  modified_base 27: mod_base = OTHER; note = 2'-O-methyluridine
  modified_base 28: mod_base = OTHER; note = 2'-O-methylguanosine
  modified_base 29: mod_base = OTHER; note = 2'-O-methyladenosine
  modified_base 30: mod_base = OTHER; note = 2'-O-methylguanosine
  modified_base 31: mod_base = OTHER; note = 2'-O-methylcytidine
  modified_base 32: mod_base = OTHER; note = 2'-O-methyladenosine
  modified_base 33: mod_base = OTHER; note = 2'-O-methyladenosine
  modified_base 34: mod_base = OTHER; note = 2'-O-methyladenosine

SEQ ID NO: 918 - RNA, 34 nt, synthetic construct; identical to SEQ ID NO: 666
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methylcytidine
  modified_base 5: mod_base = OTHER; note = 2'-O-methylguanosine
  modified_base 6: mod_base = OTHER; note = 2'-O-methyluridine
  modified_base 7: mod_base = OTHER; note = 2'-O-methyluridine
  modified_base 8: mod_base = OTHER; note = 2'-O-methylcytidine
  modified_base 9: mod_base = OTHER; note = 2'-O-methylguanosine
  modified_base 10: mod_base = OTHER; note = 2'-O-methylcytidine
  modified_base 11: mod_base = OTHER; note = 2'-O-methylcytidine
  modified_base 12: mod_base = OTHER; note = 2'-O-methylguanosine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methylguanosine
  modified_base 17: mod_base = OTHER; note = 2'-O-methylguanosine
  modified_base 18: mod_base = OTHER; note = 2'-O-methyladenosine
  modified_base 19: mod_base = OTHER; note = 2'-O-methylguanosine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluorocytidine
  modified_base 24: mod_base = OTHER; note = 2'-fluoroguanosine
  modified_base 25: mod_base = OTHER; note = 2'-O-methylguanosine
  modified_base 26: mod_base = OTHER; note = 2'-O-methylcytidine
  modified_base 27: mod_base = OTHER; note = 2'-O-methylguanosine
  modified_base 28: mod_base = OTHER; note = 2'-O-methyladenosine
  modified_base 29: mod_base = OTHER; note = 2'-O-methyladenosine
  modified_base 30: mod_base = OTHER; note = 2'-O-methylcytidine
  modified_base 31: mod_base = OTHER; note = 2'-O-methylguanosine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 919 - RNA, 34 nt, synthetic construct; identical to SEQ ID NO: 667
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methyluridine
  modified_base 5: mod_base = OTHER; note = 2'-O-methyluridine
  modified_base 6: mod_base = OTHER; note = 2'-O-methylcytidine
  modified_base 7: mod_base = OTHER; note = 2'-O-methyluridine
  modified_base 8: mod_base = OTHER; note = 2'-O-methyluridine
  modified_base 9: mod_base = OTHER; note = 2'-O-methylguanosine
  modified_base 10: mod_base = OTHER; note = 2'-O-methyladenosine
  modified_base 11: mod_base = OTHER; note = 2'-O-methyluridine
  modified_base 12: mod_base = OTHER; note = 2'-O-methylguanosine
  modified_base 13: mod_base = OTHER; note = 2'-O-methyluridine
  modified_base 14: mod_base = OTHER; note = 2'-fluoroadenosine
  modified_base 15: mod_base = OTHER; note = 2'-O-methylguanosine
  modified_base 16: mod_base = OTHER; note = 2'-O-methyladenosine
  modified_base 17: mod_base = OTHER; note = 2'-O-methylcytidine
  modified_base 18: mod_base = OTHER; note = 2'-O-methylcytidine
  modified_base 19: mod_base = OTHER; note = 2'-O-methyluridine
  modified_base 20: mod_base = OTHER; note = 2'-O-methylcytidine
  modified_base 21: mod_base = OTHER; note = 2'-O-methyluridine
  modified_base 22: mod_base = OTHER; note = 2'-fluoroadenosine
  modified_base 23: mod_base = OTHER; note = 2'-fluorocytidine
  modified_base 24: mod_base = OTHER; note = 2'-fluoroadenosine
  modified_base 25: mod_base = OTHER; note = 2'-O-methyluridine
  modified_base 26: mod_base = OTHER; note = 2'-O-methylcytidine
  modified_base 27: mod_base = OTHER; note = 2'-O-methyladenosine
  modified_base 28: mod_base = OTHER; note = 2'-O-methyladenosine
  modified_base 29: mod_base = OTHER; note = 2'-O-methylguanosine
  modified_base 30: mod_base = OTHER; note = 2'-O-methyladenosine
  modified_base 31: mod_base = OTHER; note = 2'-O-methyladenosine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 920 - RNA, 34 nt, synthetic construct; identical to SEQ ID NO: 668
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methyluridine
  modified_base 4: mod_base = OTHER; note = 2'-O-methylguanosine
  modified_base 5: mod_base = OTHER; note = 2'-O-methyladenosine
  modified_base 6: mod_base = OTHER; note = 2'-O-methylguanosine
  modified_base 7: mod_base = OTHER; note = 2'-O-methylcytidine
  modified_base 8: mod_base = OTHER; note = 2'-O-methyluridine
  modified_base 9: mod_base = OTHER; note = 2'-O-methyluridine
  modified_base 10: mod_base = OTHER; note = 2'-O-methylguanosine
  modified_base 11: mod_base = OTHER; note = 2'-O-methyladenosine
  modified_base 12: mod_base = OTHER; note = 2'-O-methyluridine
  modified_base 13: mod_base = OTHER; note = 2'-O-methylcytidine
  modified_base 14: mod_base = OTHER; note = 2'-fluoroadenosine
  modified_base 15: mod_base = OTHER; note = 2'-O-methylguanosine
  modified_base 16: mod_base = OTHER; note = 2'-O-methylguanosine
  modified_base 17: mod_base = OTHER; note = 2'-O-methylguanosine
  modified_base 18: mod_base = OTHER; note = 2'-O-methylcytidine
  modified_base 19: mod_base = OTHER; note = 2'-O-methyladenosine
  modified_base 20: mod_base = OTHER; note = 2'-O-methylcytidine
  modified_base 21: mod_base = OTHER; note = 2'-O-methyluridine
  modified_base 22: mod_base = OTHER; note = 2'-fluoroguanosine
  modified_base 23: mod_base = OTHER; note = 2'-fluoroadenosine
  modified_base 24: mod_base = OTHER; note = 2'-fluorouridine
  modified_base 25: mod_base = OTHER; note = 2'-O-methylcytidine
  modified_base 26: mod_base = OTHER; note = 2'-O-methyladenosine
  modified_base 27: mod_base = OTHER; note = 2'-O-methyladenosine
  modified_base 28: mod_base = OTHER; note = 2'-O-methylguanosine
  modified_base 29: mod_base = OTHER; note = 2'-O-methylcytidine
  modified_base 30: mod_base = OTHER; note = 2'-O-methyluridine
  modified_base 31: mod_base = OTHER; note = 2'-O-methylcytidine
  modified_base 32: mod_base = OTHER; note = 2'-O-methyladenosine
  modified_base 33: mod_base = OTHER; note = 2'-O-methyladenosine
  modified_base 34: mod_base = OTHER; note = 2'-O-methyladenosine

SEQ ID NO: 921 - RNA, 34 nt, synthetic construct; identical to SEQ ID NO: 669
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyluridine
  modified_base 4: mod_base = OTHER; note = 2'-O-methyluridine
  modified_base 5: mod_base = OTHER; note = 2'-O-methylcytidine
  modified_base 6: mod_base = OTHER; note = 2'-O-methyluridine
  modified_base 7: mod_base = OTHER; note = 2'-O-methyluridine
  modified_base 8: mod_base = OTHER; note = 2'-O-methylguanosine
  modified_base 9: mod_base = OTHER; note = 2'-O-methyladenosine
  modified_base 10: mod_base = OTHER; note = 2'-O-methyluridine
  modified_base 11: mod_base = OTHER; note = 2'-O-methylguanosine
  modified_base 12: mod_base = OTHER; note = 2'-O-methyluridine
  modified_base 13: mod_base = OTHER; note = 2'-O-methyladenosine
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-O-methylcytidine
  modified_base 17: mod_base = OTHER; note = 2'-O-methylcytidine
  modified_base 18: mod_base = OTHER; note = 2'-O-methyluridine
  modified_base 19: mod_base = OTHER; note = 2'-O-methylcytidine
  modified_base 20: mod_base = OTHER; note = 2'-O-methyluridine
  modified_base 21: mod_base = OTHER; note = 2'-O-methylcytidine
  modified_base 22: mod_base = OTHER; note = 2'-fluorouridine
  modified_base 23: mod_base = OTHER; note = 2'-fluoroadenosine
  modified_base 24: mod_base = OTHER; note = 2'-fluorocytidine
  modified_base 25: mod_base = OTHER; note = 2'-O-methyladenosine
  modified_base 26: mod_base = OTHER; note = 2'-O-methyluridine
  modified_base 27: mod_base = OTHER; note = 2'-O-methylcytidine
  modified_base 28: mod_base = OTHER; note = 2'-O-methyladenosine
  modified_base 29: mod_base = OTHER; note = 2'-O-methyladenosine
  modified_base 30: mod_base = OTHER; note = 2'-O-methylguanosine
  modified_base 31: mod_base = OTHER; note = 2'-O-methyladenosine
  modified_base 32: mod_base = OTHER; note = 2'-O-methyladenosine
  modified_base 33: mod_base = OTHER; note = 2'-O-methyluridine
  modified_base 34: mod_base = OTHER; note = 2'-O-methyladenosine

SEQ ID NO: 922 - RNA, 34 nt, synthetic construct; identical to SEQ ID NO: 670
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylguanosine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methylguanosine
  modified_base 7: mod_base = OTHER; note = 2'-O-methylguanosine
  modified_base 8: mod_base = OTHER; note = 2'-O-methyladenosine
  modified_base 9: mod_base = OTHER; note = 2'-O-methylguanosine
  modified_base 10: mod_base = OTHER; note = 2'-O-methyluridine
  modified_base 11: mod_base = OTHER; note = 2'-O-methylcytidine
  modified_base 12: mod_base = OTHER; note = 2'-O-methyluridine
  modified_base 13: mod_base = OTHER; note = 2'-O-methyluridine
  modified_base 14: mod_base = OTHER; note = 2'-fluoroguanosine
  modified_base 15: mod_base = OTHER; note = 2'-O-methylguanosine
  modified_base 16: mod_base = OTHER; note = 2'-O-methylcytidine
  modified_base 17: mod_base = OTHER; note = 2'-O-methyladenosine
  modified_base 18: mod_base = OTHER; note = 2'-O-methylguanosine
  modified_base 19: mod_base = OTHER; note = 2'-O-methylguanosine
  modified_base 20: mod_base = OTHER; note = 2'-O-methylcytidine
  modified_base 21: mod_base = OTHER; note = 2'-O-methylcytidine
  modified_base 22: mod_base = OTHER; note = 2'-fluoroadenosine
  modified_base 23: mod_base = OTHER; note = 2'-fluoroadenosine
  modified_base 24: mod_base = OTHER; note = 2'-fluoroguanosine
  modified_base 25: mod_base = OTHER; note = 2'-O-methyladenosine
  modified_base 26: mod_base = OTHER; note = 2'-O-methylcytidine
  modified_base 27: mod_base = OTHER; note = 2'-O-methyluridine
  modified_base 28: mod_base = OTHER; note = 2'-O-methylcytidine
  modified_base 29: mod_base = OTHER; note = 2'-O-methylcytidine
  modified_base 30: mod_base = OTHER; note = 2'-O-methyluridine
  modified_base 31: mod_base = OTHER; note = 2'-O-methyluridine
  modified_base 32: mod_base = OTHER; note = 2'-O-methylcytidine
  modified_base 33: mod_base = OTHER; note = 2'-O-methyladenosine
  modified_base 34: mod_base = OTHER; note = 2'-O-methyladenosine

SEQ ID NO: 923 - RNA, 34 nt, synthetic construct; identical to SEQ ID NO: 671
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methyluridine
  modified_base 4: mod_base = OTHER; note = 2'-O-methylguanosine
  modified_base 5: mod_base = OTHER; note = 2'-O-methylguanosine
  modified_base 6: mod_base = OTHER; note = 2'-O-methylcytidine
  modified_base 7: mod_base = OTHER; note = 2'-O-methyluridine
  modified_base 8: mod_base = OTHER; note = 2'-O-methyluridine
  modified_base 9: mod_base = OTHER; note = 2'-O-methylcytidine
  modified_base 10: mod_base = OTHER; note = 2'-O-methyladenosine
  modified_base 11: mod_base = OTHER; note = 2'-O-methylcytidine
  modified_base 12: mod_base = OTHER; note = 2'-O-methyladenosine
  modified_base 13: mod_base = OTHER; note = 2'-O-methylcytidine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-O-methyluridine
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methylcytidine
  modified_base 20: mod_base = OTHER; note = 2'-O-methyluridine
  modified_base 21: mod_base = OTHER; note = 2'-O-methylguanosine
  modified_base 22: mod_base = OTHER; note = 2'-fluoroguanosine
  modified_base 23: mod_base = OTHER; note = 2'-fluorouridine
  modified_base 24: mod_base = OTHER; note = 2'-fluoroguanosine
  modified_base 25: mod_base = OTHER; note = 2'-O-methyluridine
  modified_base 26: mod_base = OTHER; note = 2'-O-methylguanosine
  modified_base 27: mod_base = OTHER; note = 2'-O-methyladenosine
  modified_base 28: mod_base = OTHER; note = 2'-O-methyladenosine
  modified_base 29: mod_base = OTHER; note = 2'-O-methylguanosine
  modified_base 30: mod_base = OTHER; note = 2'-O-methylcytidine
  modified_base 31: mod_base = OTHER; note = 2'-O-methylcytidine
  modified_base 32: mod_base = OTHER; note = 2'-O-methyladenosine
  modified_base 33: mod_base = OTHER; note = 2'-O-methyladenosine
  modified_base 34: mod_base = OTHER; note = 2'-O-methyladenosine

SEQ ID NO: 924 - RNA, 34 nt, synthetic construct; identical to SEQ ID NO: 672
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyluridine
  modified_base 4: mod_base = OTHER; note = 2'-O-methylcytidine
  modified_base 5: mod_base = OTHER; note = 2'-O-methyluridine
  modified_base 6: mod_base = OTHER; note = 2'-O-methyluridine
  modified_base 7: mod_base = OTHER; note = 2'-O-methylguanosine
  modified_base 8: mod_base = OTHER; note = 2'-O-methylguanosine
  modified_base 9: mod_base = OTHER; note = 2'-O-methylcytidine
  modified_base 10: mod_base = OTHER; note = 2'-O-methyluridine
  modified_base 11: mod_base = OTHER; note = 2'-O-methyluridine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-O-methylcytidine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methyluridine
  modified_base 20: mod_base = OTHER; note = 2'-O-methyluridine
  modified_base 21: mod_base = OTHER; note = 2'-O-methylguanosine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluoroadenosine
  modified_base 25: mod_base = OTHER; note = 2'-O-methyladenosine
  modified_base 26: mod_base = OTHER; note = 2'-O-methylguanosine
  modified_base 27: mod_base = OTHER; note = 2'-O-methylcytidine
  modified_base 28: mod_base = OTHER; note = 2'-O-methylcytidine
  modified_base 29: mod_base = OTHER; note = 2'-O-methyladenosine
  modified_base 30: mod_base = OTHER; note = 2'-O-methyladenosine
  modified_base 31: mod_base = OTHER; note = 2'-O-methylguanosine
  modified_base 32: mod_base = OTHER; note = 2'-O-methyladenosine
  modified_base 33: mod_base = OTHER; note = 2'-O-methyluridine
  modified_base 34: mod_base = OTHER; note = 2'-O-methyladenosine

SEQ ID NO: 925 - RNA, 34 nt, synthetic construct; identical to SEQ ID NO: 673
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyluridine
  modified_base 4: mod_base = OTHER; note = 2'-O-methylcytidine
  modified_base 5: mod_base = OTHER; note = 2'-O-methyladenosine
  modified_base 6: mod_base = OTHER; note = 2'-O-methylcytidine
  modified_base 7: mod_base = OTHER; note = 2'-O-methyladenosine
  modified_base 8: mod_base = OTHER; note = 2'-O-methylguanosine
  modified_base 9: mod_base = OTHER; note = 2'-O-methylcytidine
  modified_base 10: mod_base = OTHER; note = 2'-O-methyluridine
  modified_base 11: mod_base = OTHER; note = 2'-O-methylguanosine
  modified_base 12: mod_base = OTHER; note = 2'-O-methylcytidine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methyluridine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methyluridine
  modified_base 19: mod_base = OTHER; note = 2'-O-methyluridine
  modified_base 20: mod_base = OTHER; note = 2'-O-methyladenosine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluoroguanosine
  modified_base 24: mod_base = OTHER; note = 2'-fluorocytidine
  modified_base 25: mod_base = OTHER; note = 2'-O-methyladenosine
  modified_base 26: mod_base = OTHER; note = 2'-O-methylguanosine
  modified_base 27: mod_base = OTHER; note = 2'-O-methylcytidine
  modified_base 28: mod_base = OTHER; note = 2'-O-methyluridine
  modified_base 29: mod_base = OTHER; note = 2'-O-methylguanosine
  modified_base 30: mod_base = OTHER; note = 2'-O-methyluridine
  modified_base 31: mod_base = OTHER; note = 2'-O-methylguanosine
  modified_base 32: mod_base = OTHER; note = 2'-O-methyladenosine
  modified_base 33: mod_base = OTHER; note = 2'-O-methylguanosine
  modified_base 34: mod_base = OTHER; note = 2'-O-methyladenosine

SEQ ID NO: 926 - RNA, 34 nt, synthetic construct; identical to SEQ ID NO: 674
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methylcytidine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyluridine
  modified_base 7: mod_base = OTHER; note = 2'-O-methylguanosine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methylguanosine
  modified_base 11: mod_base = OTHER; note = 2'-O-methyluridine
  modified_base 12: mod_base = OTHER; note = 2'-O-methylcytidine
  modified_base 13: mod_base = OTHER; note = 2'-O-methyluridine
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methylcytidine
  modified_base 19: mod_base = OTHER; note = 2'-O-methyladenosine
  modified_base 20: mod_base = OTHER; note = 2'-O-methyluridine
  modified_base 21: mod_base = OTHER; note = 2'-O-methylcytidine
  modified_base 22: mod_base = OTHER; note = 2'-fluoroadenosine
  modified_base 23: mod_base = OTHER; note = 2'-fluoroguanosine
  modified_base 24: mod_base = OTHER; note = 2'-fluoroadenosine
  modified_base 25: mod_base = OTHER; note = 2'-O-methylcytidine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methylcytidine
  modified_base 29: mod_base = OTHER; note = 2'-O-methyladenosine
  modified_base 30: mod_base = OTHER; note = 2'-O-methyluridine
  modified_base 31: mod_base = OTHER; note = 2'-O-methyluridine
  modified_base 32: mod_base = OTHER; note = 2'-O-methylguanosine
  modified_base 33: mod_base = OTHER; note = 2'-O-methylguanosine
  modified_base 34: mod_base = OTHER; note = 2'-O-methyladenosine

SEQ ID NO: 927 - RNA, 34 nt, synthetic construct; identical to SEQ ID NO: 675
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-O-methylguanosine
  modified_base 5: mod_base = OTHER; note = 2'-O-methyluridine
  modified_base 6: mod_base = OTHER; note = 2'-O-methylguanosine
  modified_base 7: mod_base = OTHER; note = 2'-O-methylguanosine
  modified_base 8: mod_base = OTHER; note = 2'-O-methyluridine
  modified_base 9: mod_base = OTHER; note = 2'-O-methylguanosine
  modified_base 10: mod_base = OTHER; note = 2'-O-methylguanosine
  modified_base 11: mod_base = OTHER; note = 2'-O-methyluridine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-O-methylcytidine
  modified_base 17: mod_base = OTHER; note = 2'-O-methylcytidine
  modified_base 18: mod_base = OTHER; note = 2'-O-methyluridine
  modified_base 19: mod_base = OTHER; note = 2'-O-methylcytidine
  modified_base 20: mod_base = OTHER; note = 2'-O-methyluridine
  modified_base 21: mod_base = OTHER; note = 2'-O-methylguanosine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluoroadenosine
  modified_base 25: mod_base = OTHER; note = 2'-O-methylcytidine
  modified_base 26: mod_base = OTHER; note = 2'-O-methylcytidine
  modified_base 27: mod_base = OTHER; note = 2'-O-methyladenosine
  modified_base 28: mod_base = OTHER; note = 2'-O-methylcytidine
  modified_base 29: mod_base = OTHER; note = 2'-O-methylcytidine
  modified_base 30: mod_base = OTHER; note = 2'-O-methyladenosine
  modified_base 31: mod_base = OTHER; note = 2'-O-methylcytidine
  modified_base 32: mod_base = OTHER; note = 2'-O-methyluridine
  modified_base 33: mod_base = OTHER; note = 2'-O-methylcytidine
  modified_base 34: mod_base = OTHER; note = 2'-O-methyladenosine

SEQ ID NO: 928 - RNA, 34 nt, synthetic construct; identical to SEQ ID NO: 676
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyluridine
  modified_base 4: mod_base = OTHER; note = 2'-O-methyladenosine
  modified_base 5: mod_base = OTHER; note = 2'-O-methylguanosine
  modified_base 6: mod_base = OTHER; note = 2'-O-methylguanosine
  modified_base 7: mod_base = OTHER; note = 2'-O-methylguanosine
  modified_base 8: mod_base = OTHER; note = 2'-O-methyladenosine
  modified_base 9: mod_base = OTHER; note = 2'-O-methylcytidine
  modified_base 10: mod_base = OTHER; note = 2'-O-methyluridine
  modified_base 11: mod_base = OTHER; note = 2'-O-methylcytidine
  modified_base 12: mod_base = OTHER; note = 2'-O-methyladenosine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methylcytidine
  modified_base 16: mod_base = OTHER; note = 2'-O-methylcytidine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methylcytidine
  modified_base 20: mod_base = OTHER; note = 2'-O-methylguanosine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluorouridine
  modified_base 24: mod_base = OTHER; note = 2'-fluoroguanosine
  modified_base 25: mod_base = OTHER; note = 2'-O-methyladenosine
  modified_base 26: mod_base = OTHER; note = 2'-O-methylguanosine
  modified_base 27: mod_base = OTHER; note = 2'-O-methyluridine
  modified_base 28: mod_base = OTHER; note = 2'-O-methylcytidine
  modified_base 29: mod_base = OTHER; note = 2'-O-methylcytidine
  modified_base 30: mod_base = OTHER; note = 2'-O-methylcytidine
  modified_base 31: mod_base = OTHER; note = 2'-O-methyluridine
  modified_base 32: mod_base = OTHER; note = 2'-O-methyladenosine
  modified_base 33: mod_base = OTHER; note = 2'-O-methyluridine
  modified_base 34: mod_base = OTHER; note = 2'-O-methyladenosine

SEQ ID NO: 929 - RNA, 34 nt, synthetic construct; identical to SEQ ID NO: 677
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyluridine
  modified_base 4: mod_base = OTHER; note = 2'-O-methylguanosine
  modified_base 5: mod_base = OTHER; note = 2'-O-methyladenosine
  modified_base 6: mod_base = OTHER; note = 2'-O-methylcytidine
  modified_base 7: mod_base = OTHER; note = 2'-O-methyluridine
  modified_base 8: mod_base = OTHER; note = 2'-O-methyluridine
  modified_base 9: mod_base = OTHER; note = 2'-O-methylcytidine
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-O-methylcytidine
  modified_base 13: mod_base = OTHER; note = 2'-O-methyluridine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methyluridine
  modified_base 17: mod_base = OTHER; note = 2'-O-methylguanosine
  modified_base 18: mod_base = OTHER; note = 2'-O-methylguanosine
  modified_base 19: mod_base = OTHER; note = 2'-O-methyluridine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluoroadenosine
  modified_base 23: mod_base = OTHER; note = 2'-fluoroguanosine
  modified_base 24: mod_base = OTHER; note = 2'-fluorouridine
  modified_base 25: mod_base = OTHER; note = 2'-O-methyluridine
  modified_base 26: mod_base = OTHER; note = 2'-O-methylguanosine
  modified_base 27: mod_base = OTHER; note = 2'-O-methyladenosine
  modified_base 28: mod_base = OTHER; note = 2'-O-methyladenosine
  modified_base 29: mod_base = OTHER; note = 2'-O-methylguanosine
  modified_base 30: mod_base = OTHER; note = 2'-O-methyluridine
  modified_base 31: mod_base = OTHER; note = 2'-O-methylcytidine
  modified_base 32: mod_base = OTHER; note = 2'-O-methyladenosine
  modified_base 33: mod_base = OTHER; note = 2'-O-methylguanosine
  modified_base 34: mod_base = OTHER; note = 2'-O-methyladenosine

SEQ ID NO: 930 - RNA, 34 nt, synthetic construct; identical to SEQ ID NO: 678
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methyluridine
  modified_base 4: mod_base = OTHER; note = 2'-O-methylcytidine
  modified_base 5: mod_base = OTHER; note = 2'-O-methyluridine
  modified_base 6: mod_base = OTHER; note = 2'-O-methylcytidine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-O-methyluridine
  modified_base 10: mod_base = OTHER; note = 2'-O-methyluridine
  modified_base 11: mod_base = OTHER; note = 2'-O-methyladenosine
  modified_base 12: mod_base = OTHER; note = 2'-O-methyladenosine
  modified_base 13: mod_base = OTHER; note = 2'-O-methylguanosine
  modified_base 14: mod_base = OTHER; note = 2'-fluorouridine
  modified_base 15: mod_base = OTHER; note = 2'-O-methyluridine
  modified_base 16: mod_base = OTHER; note = 2'-O-methylguanosine
  modified_base 17: mod_base = OTHER; note = 2'-O-methyladenosine
  modified_base 18: mod_base = OTHER; note = 2'-O-methylcytidine
  modified_base 19: mod_base = OTHER; note = 2'-O-methyluridine
  modified_base 20: mod_base = OTHER; note = 2'-O-methyladenosine
  modified_base 21: mod_base = OTHER; note = 2'-O-methyladenosine
  modified_base 22: mod_base = OTHER; note = 2'-fluorocytidine
  modified_base 23: mod_base = OTHER; note = 2'-fluorouridine
  modified_base 24: mod_base = OTHER; note = 2'-fluorouridine
  modified_base 25: mod_base = OTHER; note = 2'-O-methyladenosine
  modified_base 26: mod_base = OTHER; note = 2'-O-methyladenosine
  modified_base 27: mod_base = OTHER; note = 2'-O-methyluridine
  modified_base 28: mod_base = OTHER; note = 2'-O-methyluridine
  modified_base 29: mod_base = OTHER; note = 2'-O-methylguanosine
  modified_base 30: mod_base = OTHER; note = 2'-O-methyladenosine
  modified_base 31: mod_base = OTHER; note = 2'-O-methylguanosine
  modified_base 32: mod_base = OTHER; note = 2'-O-methyladenosine
  modified_base 33: mod_base = OTHER; note = 2'-O-methyladenosine
  modified_base 34: mod_base = OTHER; note = 2'-O-methyladenosine

SEQ ID NO: 931 - RNA, 34 nt, synthetic construct; identical to SEQ ID NO: 679
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylguanosine
  modified_base 4: mod_base = OTHER; note = 2'-O-methyluridine
  modified_base 5: mod_base = OTHER; note = 2'-O-methyluridine
  modified_base 6: mod_base = OTHER; note = 2'-O-methyluridine
  modified_base 7: mod_base = OTHER; note = 2'-O-methylcytidine
  modified_base 8: mod_base = OTHER; note = 2'-O-methyluridine
  modified_base 9: mod_base = OTHER; note = 2'-O-methylcytidine
  modified_base 10: mod_base = OTHER; note = 2'-O-methylcytidine
  modified_base 11: mod_base = OTHER; note = 2'-O-methyluridine
  modified_base 12: mod_base = OTHER; note = 2'-O-methyluridine
  modified_base 13: mod_base = OTHER; note = 2'-O-methylcytidine
  modified_base 14: mod_base = OTHER; note = 2'-fluoroadenosine
  modified_base 15: mod_base = OTHER; note = 2'-O-methylguanosine
  modified_base 16: mod_base = OTHER; note = 2'-O-methylcytidine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methylguanosine
  modified_base 20: mod_base = OTHER; note = 2'-O-methylcytidine
  modified_base 21: mod_base = OTHER; note = 2'-O-methyluridine
  modified_base 22: mod_base = OTHER; note = 2'-fluoroguanosine
  modified_base 23: mod_base = OTHER; note = 2'-fluoroadenosine
  modified_base 24: mod_base = OTHER; note = 2'-fluoroadenosine
  modified_base 25: mod_base = OTHER; note = 2'-O-methylguanosine
  modified_base 26: mod_base = OTHER; note = 2'-O-methylguanosine
  modified_base 27: mod_base = OTHER; note = 2'-O-methyladenosine
  modified_base 28: mod_base = OTHER; note = 2'-O-methylguanosine
  modified_base 29: mod_base = OTHER; note = 2'-O-methyladenosine
  modified_base 30: mod_base = OTHER; note = 2'-O-methyladenosine
  modified_base 31: mod_base = OTHER; note = 2'-O-methyladenosine
  modified_base 32: mod_base = OTHER; note = 2'-O-methylcytidine
  modified_base 33: mod_base = OTHER; note = 2'-O-methyluridine
  modified_base 34: mod_base = OTHER; note = 2'-O-methyladenosine

SEQ ID NO: 932 - RNA, 34 nt, synthetic construct; identical to SEQ ID NO: 680
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylguanosine
  modified_base 4: mod_base = OTHER; note = 2'-O-methylcytidine
  modified_base 5: mod_base = OTHER; note = 2'-O-methyluridine
  modified_base 6: mod_base = OTHER; note = 2'-O-methyluridine
  modified_base 7: mod_base = OTHER; note = 2'-O-methyluridine
  modified_base 8: mod_base = OTHER; note = 2'-O-methylguanosine
  modified_base 9: mod_base = OTHER; note = 2'-O-methyladenosine
  modified_base 10: mod_base = OTHER; note = 2'-O-methyluridine
  modified_base 11: mod_base = OTHER; note = 2'-O-methyladenosine
  modified_base 12: mod_base = OTHER; note = 2'-O-methyluridine
  modified_base 13: mod_base = OTHER; note = 2'-O-methylcytidine
  modified_base 14: mod_base = OTHER; note = 2'-fluorocytidine
  modified_base 15: mod_base = OTHER; note = 2'-O-methyluridine
  modified_base 16: mod_base = OTHER; note = 2'-O-methylguanosine
  modified_base 17: mod_base = OTHER; note = 2'-O-methyluridine
  modified_base 18: mod_base = OTHER; note = 2'-O-methylguanosine
  modified_base 19: mod_base = OTHER; note = 2'-O-methylcytidine
  modified_base 20: mod_base = OTHER; note = 2'-O-methyladenosine
  modified_base 21: mod_base = OTHER; note = 2'-O-methylguanosine
  modified_base 22: mod_base = OTHER; note = 2'-fluoroguanosine
  modified_base 23: mod_base = OTHER; note = 2'-fluoroadenosine
  modified_base 24: mod_base = OTHER; note = 2'-fluorouridine
  modified_base 25: mod_base = OTHER; note = 2'-O-methyladenosine
  modified_base 26: mod_base = OTHER; note = 2'-O-methyluridine
  modified_base 27: mod_base = OTHER; note = 2'-O-methylcytidine
  modified_base 28: mod_base = OTHER; note = 2'-O-methyladenosine
  modified_base 29: mod_base = OTHER; note = 2'-O-methyladenosine
  modified_base 30: mod_base = OTHER; note = 2'-O-methyladenosine
  modified_base 31: mod_base = OTHER; note = 2'-O-methylguanosine
  modified_base 32: mod_base = OTHER; note = 2'-O-methylcytidine
  modified_base 33: mod_base = OTHER; note = 2'-O-methyluridine
  modified_base 34: mod_base = OTHER; note = 2'-O-methyladenosine

SEQ ID NO: 933 - RNA, 34 nt, synthetic construct; identical to SEQ ID NO: 681
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylguanosine
  modified_base 4: mod_base = OTHER; note = 2'-O-methyluridine
  modified_base 5: mod_base = OTHER; note = 2'-O-methylcytidine
  modified_base 6: mod_base = OTHER; note = 2'-O-methylcytidine
  modified_base 7: mod_base = OTHER; note = 2'-O-methyluridine
  modified_base 8: mod_base = OTHER; note = 2'-O-methyluridine
  modified_base 9: mod_base = OTHER; note = 2'-O-methylguanosine
  modified_base 10: mod_base = OTHER; note = 2'-O-methyladenosine
  modified_base 11: mod_base = OTHER; note = 2'-O-methylcytidine
  modified_base 12: mod_base = OTHER; note = 2'-O-methyluridine
  modified_base 13: mod_base = OTHER; note = 2'-O-methyluridine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methyluridine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluoroadenosine
  modified_base 23: mod_base = OTHER; note = 2'-fluoroadenosine
  modified_base 24: mod_base = OTHER; note = 2'-fluoroguanosine
  modified_base 25: mod_base = OTHER; note = 2'-O-methyluridine
  modified_base 26: mod_base = OTHER; note = 2'-O-methylcytidine
  modified_base 27: mod_base = OTHER; note = 2'-O-methyladenosine
  modified_base 28: mod_base = OTHER; note = 2'-O-methyladenosine
  modified_base 29: mod_base = OTHER; note = 2'-O-methylguanosine
  modified_base 30: mod_base = OTHER; note = 2'-O-methylguanosine
  modified_base 31: mod_base = OTHER; note = 2'-O-methyladenosine
  modified_base 32: mod_base = OTHER; note = 2'-O-methylcytidine
  modified_base 33: mod_base = OTHER; note = 2'-O-methyladenosine
  modified_base 34: mod_base = OTHER; note = 2'-O-methyladenosine

SEQ ID NO: 934 - RNA, 34 nt, synthetic construct; identical to SEQ ID NO: 682
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methylguanosine
  modified_base 5: mod_base = OTHER; note = 2'-O-methylguanosine
  modified_base 6: mod_base = OTHER; note = 2'-O-methyluridine
  modified_base 7: mod_base = OTHER; note = 2'-O-methyladenosine
  modified_base 8: mod_base = OTHER; note = 2'-O-methylcytidine
  modified_base 9: mod_base = OTHER; note = 2'-O-methylguanosine
  modified_base 10: mod_base = OTHER; note = 2'-O-methyluridine
  modified_base 11: mod_base = OTHER; note = 2'-O-methylguanosine
  modified_base 12: mod_base = OTHER; note = 2'-O-methyluridine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methylcytidine
  modified_base 17: mod_base = OTHER; note = 2'-O-methyladenosine
  modified_base 18: mod_base = OTHER; note = 2'-O-methylcytidine
  modified_base 19: mod_base = OTHER; note = 2'-O-methyladenosine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluoroadenosine
  modified_base 24: mod_base = OTHER; note = 2'-fluorocytidine
  modified_base 25: mod_base = OTHER; note = 2'-O-methyladenosine
  modified_base 26: mod_base = OTHER; note = 2'-O-methylcytidine
  modified_base 27: mod_base = OTHER; note = 2'-O-methylguanosine
  modified_base 28: mod_base = OTHER; note = 2'-O-methyluridine
  modified_base 29: mod_base = OTHER; note = 2'-O-methyladenosine
  modified_base 30: mod_base = OTHER; note = 2'-O-methylcytidine
  modified_base 31: mod_base = OTHER; note = 2'-O-methylcytidine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 935 - RNA, 34 nt, synthetic construct; identical to SEQ ID NO: 683
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methylcytidine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyluridine
  modified_base 9: mod_base = OTHER; note = 2'-O-methylguanosine
  modified_base 10: mod_base = OTHER; note = 2'-O-methyluridine
  modified_base 11: mod_base = OTHER; note = 2'-O-methylguanosine
  modified_base 12: mod_base = OTHER; note = 2'-O-methylcytidine
  modified_base 13: mod_base = OTHER; note = 2'-O-methyluridine
  modified_base 14: mod_base = OTHER; note = 2'-fluoroguanosine
  modified_base 15: mod_base = OTHER; note = 2'-O-methylcytidine
  modified_base 16: mod_base = OTHER; note = 2'-O-methyluridine
  modified_base 17: mod_base = OTHER; note = 2'-O-methylguanosine
  modified_base 18: mod_base = OTHER; note = 2'-O-methyluridine
  modified_base 19: mod_base = OTHER; note = 2'-O-methylcytidine
  modified_base 20: mod_base = OTHER; note = 2'-O-methylguanosine
  modified_base 21: mod_base = OTHER; note = 2'-O-methylcytidine
  modified_base 22: mod_base = OTHER; note = 2'-fluoroadenosine
  modified_base 23: mod_base = OTHER; note = 2'-fluoroguanosine
  modified_base 24: mod_base = OTHER; note = 2'-fluorocytidine
  modified_base 25: mod_base = OTHER; note = 2'-O-methyladenosine
  modified_base 26: mod_base = OTHER; note = 2'-O-methylcytidine
  modified_base 27: mod_base = OTHER; note = 2'-O-methyladenosine
  modified_base 28: mod_base = OTHER; note = 2'-O-methyluridine
  modified_base 29: mod_base = OTHER; note = 2'-O-methyluridine
  modified_base 30: mod_base = OTHER; note = 2'-O-methylguanosine
  modified_base 31: mod_base = OTHER; note = 2'-O-methyluridine
  modified_base 32: mod_base = OTHER; note = 2'-O-methyluridine
  modified_base 33: mod_base = OTHER; note = 2'-O-methyluridine
  modified_base 34: mod_base = OTHER; note = 2'-O-methyladenosine

SEQ ID NO: 936 - RNA, 34 nt, synthetic construct; identical to SEQ ID NO: 684
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyluridine
  modified_base 4: mod_base = OTHER; note = 2'-O-methyladenosine
  modified_base 5: mod_base = OTHER; note = 2'-O-methyluridine
  modified_base 6: mod_base = OTHER; note = 2'-O-methylcytidine
  modified_base 7: mod_base = OTHER; note = 2'-O-methylcytidine
  modified_base 8: mod_base = OTHER; note = 2'-O-methyluridine
  modified_base 9: mod_base = OTHER; note = 2'-O-methylguanosine
  modified_base 10: mod_base = OTHER; note = 2'-O-methyluridine
  modified_base 11: mod_base = OTHER; note = 2'-O-methylguanosine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluoroguanosine
  modified_base 15: mod_base = OTHER; note = 2'-O-methylguanosine
  modified_base 16: mod_base = OTHER; note = 2'-O-methylguanosine
  modified_base 17: mod_base = OTHER; note = 2'-O-methyladenosine
  modified_base 18: mod_base = OTHER; note = 2'-O-methylguanosine
  modified_base 19: mod_base = OTHER; note = 2'-O-methylcytidine
  modified_base 20: mod_base = OTHER; note = 2'-O-methylcytidine
  modified_base 21: mod_base = OTHER; note = 2'-O-methylcytidine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluorocytidine
  modified_base 25: mod_base = OTHER; note = 2'-O-methyladenosine
  modified_base 26: mod_base = OTHER; note = 2'-O-methylcytidine
  modified_base 27: mod_base = OTHER; note = 2'-O-methyladenosine
  modified_base 28: mod_base = OTHER; note = 2'-O-methylguanosine
  modified_base 29: mod_base = OTHER; note = 2'-O-methylguanosine
  modified_base 30: mod_base = OTHER; note = 2'-O-methyladenosine
  modified_base 31: mod_base = OTHER; note = 2'-O-methyluridine
  modified_base 32: mod_base = OTHER; note = 2'-O-methyladenosine
  modified_base 33: mod_base = OTHER; note = 2'-O-methyluridine
  modified_base 34: mod_base = OTHER; note = 2'-O-methyladenosine

SEQ ID NO: 937 - RNA, 34 nt, synthetic construct; identical to SEQ ID NO: 685
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-O-methylcytidine
  modified_base 5: mod_base = OTHER; note = 2'-O-methyluridine
  modified_base 6: mod_base = OTHER; note = 2'-O-methylcytidine
  modified_base 7: mod_base = OTHER; note = 2'-O-methyladenosine
  modified_base 8: mod_base = OTHER; note = 2'-O-methylguanosine
  modified_base 9: mod_base = OTHER; note = 2'-O-methyladenosine
  modified_base 10: mod_base = OTHER; note = 2'-O-methylguanosine
  modified_base 11: mod_base = OTHER; note = 2'-O-methyladenosine
  modified_base 12: mod_base = OTHER; note = 2'-O-methylcytidine
  modified_base 13: mod_base = OTHER; note = 2'-O-methyluridine
  modified_base 14: mod_base = OTHER; note = 2'-fluoroguanosine
  modified_base 15: mod_base = OTHER; note = 2'-O-methylguanosine
  modified_base 16: mod_base = OTHER; note = 2'-O-methylcytidine
  modified_base 17: mod_base = OTHER; note = 2'-O-methyluridine
  modified_base 18: mod_base = OTHER; note = 2'-O-methyluridine
  modified_base 19: mod_base = OTHER; note = 2'-O-methyluridine
  modified_base 20: mod_base = OTHER; note = 2'-O-methylcytidine
  modified_base 21: mod_base = OTHER; note = 2'-O-methylcytidine
  modified_base 22: mod_base = OTHER; note = 2'-fluoroadenosine
  modified_base 23: mod_base = OTHER; note = 2'-fluoroguanosine
  modified_base 24: mod_base = OTHER; note = 2'-fluorouridine
  modified_base 25: mod_base = OTHER; note = 2'-O-methylcytidine
  modified_base 26: mod_base = OTHER; note = 2'-O-methyluridine
  modified_base 27: mod_base = OTHER; note = 2'-O-methylcytidine
  modified_base 28: mod_base = OTHER; note = 2'-O-methyluridine
  modified_base 29: mod_base = OTHER; note = 2'-O-methylguanosine
  modified_base 30: mod_base = OTHER; note = 2'-O-methyladenosine
  modified_base 31: mod_base = OTHER; note = 2'-O-methylguanosine
  modified_base 32: mod_base = OTHER; note = 2'-O-methyluridine
  modified_base 33: mod_base = OTHER; note = 2'-O-methylcytidine
  modified_base 34: mod_base = OTHER; note = 2'-O-methyladenosine

SEQ ID NO: 938 - RNA, 34 nt, synthetic construct; identical to SEQ ID NO: 686
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methyluridine
  modified_base 6: mod_base = OTHER; note = 2'-O-methylguanosine
  modified_base 7: mod_base = OTHER; note = 2'-O-methyladenosine
  modified_base 8: mod_base = OTHER; note = 2'-O-methylcytidine
  modified_base 9: mod_base = OTHER; note = 2'-O-methyladenosine
  modified_base 10: mod_base = OTHER; note = 2'-O-methylguanosine
  modified_base 11: mod_base = OTHER; note = 2'-O-methyluridine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyluridine
  modified_base 16: mod_base = OTHER; note = 2'-O-methylguanosine
  modified_base 17: mod_base = OTHER; note = 2'-O-methylguanosine
  modified_base 18: mod_base = OTHER; note = 2'-O-methylguanosine
  modified_base 19: mod_base = OTHER; note = 2'-O-methyluridine
  modified_base 20: mod_base = OTHER; note = 2'-O-methyladenosine
  modified_base 21: mod_base = OTHER; note = 2'-O-methyladenosine
  modified_base 22: mod_base = OTHER; note = 2'-fluorouridine
  modified_base 23: mod_base = OTHER; note = 2'-fluorouridine
  modified_base 24: mod_base = OTHER; note = 2'-fluoroadenosine
  modified_base 25: mod_base = OTHER; note = 2'-O-methylcytidine
  modified_base 26: mod_base = OTHER; note = 2'-O-methyluridine
  modified_base 27: mod_base = OTHER; note = 2'-O-methylguanosine
  modified_base 28: mod_base = OTHER; note = 2'-O-methyluridine
  modified_base 29: mod_base = OTHER; note = 2'-O-methylcytidine
  modified_base 30: mod_base = OTHER; note = 2'-O-methyladenosine
  modified_base 31: mod_base = OTHER; note = 2'-O-methyluridine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 939 - RNA, 34 nt, synthetic construct; identical to SEQ ID NO: 687
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-O-methylguanosine
  modified_base 5: mod_base = OTHER; note = 2'-O-methylcytidine
  modified_base 6: mod_base = OTHER; note = 2'-O-methylcytidine
  modified_base 7: mod_base = OTHER; note = 2'-O-methyladenosine
  modified_base 8: mod_base = OTHER; note = 2'-O-methylcytidine
  modified_base 9: mod_base = OTHER; note = 2'-O-methylcytidine
  modified_base 10: mod_base = OTHER; note = 2'-O-methyluridine
  modified_base 11: mod_base = OTHER; note = 2'-O-methyluridine
  modified_base 12: mod_base = OTHER; note = 2'-O-methylcytidine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methyladenosine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methylcytidine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluoroguanosine
  modified_base 24: mod_base = OTHER; note = 2'-fluoroadenosine
  modified_base 25: mod_base = OTHER; note = 2'-O-methyladenosine
  modified_base 26: mod_base = OTHER; note = 2'-O-methylguanosine
  modified_base 27: mod_base = OTHER; note = 2'-O-methylguanosine
  modified_base 28: mod_base = OTHER; note = 2'-O-methyluridine
  modified_base 29: mod_base = OTHER; note = 2'-O-methylguanosine
  modified_base 30: mod_base = OTHER; note = 2'-O-methylguanosine
  modified_base 31: mod_base = OTHER; note = 2'-O-methylcytidine
  modified_base 32: mod_base = OTHER; note = 2'-O-methyluridine
  modified_base 33: mod_base = OTHER; note = 2'-O-methylcytidine
  modified_base 34: mod_base = OTHER; note = 2'-O-methyladenosine

SEQ ID NO: 940 - RNA, 34 nt, synthetic construct; identical to SEQ ID NO: 688
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyluridine
  modified_base 4: mod_base = OTHER; note = 2'-O-methyluridine
  modified_base 5: mod_base = OTHER; note = 2'-O-methylguanosine
  modified_base 6: mod_base = OTHER; note = 2'-O-methyladenosine
  modified_base 7: mod_base = OTHER; note = 2'-O-methylcytidine
  modified_base 8: mod_base = OTHER; note = 2'-O-methyluridine
  modified_base 9: mod_base = OTHER; note = 2'-O-methyluridine
  modified_base 10: mod_base = OTHER; note = 2'-O-methyluridine
  modified_base 11: mod_base = OTHER; note = 2'-O-methylguanosine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-O-methylcytidine
  modified_base 17: mod_base = OTHER; note = 2'-O-methyladenosine
  modified_base 18: mod_base = OTHER; note = 2'-O-methyluridine
  modified_base 19: mod_base = OTHER; note = 2'-O-methylguanosine
  modified_base 20: mod_base = OTHER; note = 2'-O-methyluridine
  modified_base 21: mod_base = OTHER; note = 2'-O-methylguanosine
  modified_base 22: mod_base = OTHER; note = 2'-fluorouridine
  modified_base 23: mod_base = OTHER; note = 2'-fluorouridine
  modified_base 24: mod_base = OTHER; note = 2'-fluorocytidine
  modified_base 25: mod_base = OTHER; note = 2'-O-methyladenosine
  modified_base 26: mod_base = OTHER; note = 2'-O-methyladenosine
  modified_base 27: mod_base = OTHER; note = 2'-O-methyladenosine
  modified_base 28: mod_base = OTHER; note = 2'-O-methylguanosine
  modified_base 29: mod_base = OTHER; note = 2'-O-methyluridine
  modified_base 30: mod_base = OTHER; note = 2'-O-methylcytidine
  modified_base 31: mod_base = OTHER; note = 2'-O-methyladenosine
  modified_base 32: mod_base = OTHER; note = 2'-O-methyladenosine
  modified_base 33: mod_base = OTHER; note = 2'-O-methylguanosine
  modified_base 34: mod_base = OTHER; note = 2'-O-methyladenosine

SEQ ID NO: 941 - RNA, 34 nt, synthetic construct; identical to SEQ ID NO: 689
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyluridine
  modified_base 4: mod_base = OTHER; note = 2'-O-methylguanosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methylcytidine
  modified_base 9: mod_base = OTHER; note = 2'-O-methylguanosine
  modified_base 10: mod_base = OTHER; note = 2'-O-methyladenosine
  modified_base 11: mod_base = OTHER; note = 2'-O-methylcytidine
  modified_base 12: mod_base = OTHER; note = 2'-O-methyluridine
  modified_base 13: mod_base = OTHER; note = 2'-O-methyluridine
  modified_base 14: mod_base = OTHER; note = 2'-fluorocytidine
  modified_base 15: mod_base = OTHER; note = 2'-O-methyluridine
  modified_base 16: mod_base = OTHER; note = 2'-O-methylcytidine
  modified_base 17: mod_base = OTHER; note = 2'-O-methyluridine
  modified_base 18: mod_base = OTHER; note = 2'-O-methyluridine
  modified_base 19: mod_base = OTHER; note = 2'-O-methylguanosine
  modified_base 20: mod_base = OTHER; note = 2'-O-methyladenosine
  modified_base 21: mod_base = OTHER; note = 2'-O-methylguanosine
  modified_base 22: mod_base = OTHER; note = 2'-fluoroadenosine
  modified_base 23: mod_base = OTHER; note = 2'-fluoroadenosine
  modified_base 24: mod_base = OTHER; note = 2'-fluoroguanosine
  modified_base 25: mod_base = OTHER; note = 2'-O-methyluridine
  modified_base 26: mod_base = OTHER; note = 2'-O-methylcytidine
  modified_base 27: mod_base = OTHER; note = 2'-O-methylguanosine
  modified_base 28: mod_base = OTHER; note = 2'-O-methyluridine
  modified_base 29: mod_base = OTHER; note = 2'-O-methyluridine
  modified_base 30: mod_base = OTHER; note = 2'-O-methyluridine
  modified_base 31: mod_base = OTHER; note = 2'-O-methylcytidine
  modified_base 32: mod_base = OTHER; note = 2'-O-methyladenosine
  modified_base 33: mod_base = OTHER; note = 2'-O-methyluridine
  modified_base 34: mod_base = OTHER; note = 2'-O-methyladenosine

SEQ ID NO: 942 - RNA, 34 nt, synthetic construct; identical to SEQ ID NO: 690
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methylguanosine
  modified_base 6: mod_base = OTHER; note = 2'-O-methyladenosine
  modified_base 7: mod_base = OTHER; note = 2'-O-methylcytidine
  modified_base 8: mod_base = OTHER; note = 2'-O-methyladenosine
  modified_base 9: mod_base = OTHER; note = 2'-O-methylguanosine
  modified_base 10: mod_base = OTHER; note = 2'-O-methylguanosine
  modified_base 11: mod_base = OTHER; note = 2'-O-methyladenosine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-fluoroguanosine
  modified_base 15: mod_base = OTHER; note = 2'-O-methylcytidine
  modified_base 16: mod_base = OTHER; note = 2'-O-methyluridine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methylguanosine
  modified_base 20: mod_base = OTHER; note = 2'-O-methylguanosine
  modified_base 21: mod_base = OTHER; note = 2'-O-methylcytidine
  modified_base 22: mod_base = OTHER; note = 2'-fluorouridine
  modified_base 23: mod_base = OTHER; note = 2'-fluorouridine
  modified_base 24: mod_base = OTHER; note = 2'-fluorouridine
  modified_base 25: mod_base = OTHER; note = 2'-O-methylcytidine
  modified_base 26: mod_base = OTHER; note = 2'-O-methylcytidine
  modified_base 27: mod_base = OTHER; note = 2'-O-methyluridine
  modified_base 28: mod_base = OTHER; note = 2'-O-methylguanosine
  modified_base 29: mod_base = OTHER; note = 2'-O-methyluridine
  modified_base 30: mod_base = OTHER; note = 2'-O-methylcytidine
  modified_base 31: mod_base = OTHER; note = 2'-O-methyluridine
  modified_base 32: mod_base = OTHER; note = 2'-O-methyluridine
  modified_base 33: mod_base = OTHER; note = 2'-O-methylcytidine
  modified_base 34: mod_base = OTHER; note = 2'-O-methyladenosine

SEQ ID NO: 943 - RNA, 34 nt, synthetic construct; identical to SEQ ID NO: 691
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methylcytidine
  modified_base 4: mod_base = OTHER; note = 2'-O-methyluridine
  modified_base 5: mod_base = OTHER; note = 2'-O-methyluridine
  modified_base 6: mod_base = OTHER; note = 2'-O-methyluridine
  modified_base 7: mod_base = OTHER; note = 2'-O-methylguanosine
  modified_base 8: mod_base = OTHER; note = 2'-O-methyladenosine
  modified_base 9: mod_base = OTHER; note = 2'-O-methyluridine
  modified_base 10: mod_base = OTHER; note = 2'-O-methyladenosine
  modified_base 11: mod_base = OTHER; note = 2'-O-methyluridine
  modified_base 12: mod_base = OTHER; note = 2'-O-methylcytidine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methyluridine
  modified_base 17: mod_base = OTHER; note = 2'-O-methylguanosine
  modified_base 18: mod_base = OTHER; note = 2'-O-methylcytidine
  modified_base 19: mod_base = OTHER; note = 2'-O-methyladenosine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluoroguanosine
  modified_base 24: mod_base = OTHER; note = 2'-fluoroadenosine
  modified_base 25: mod_base = OTHER; note = 2'-O-methyluridine
  modified_base 26: mod_base = OTHER; note = 2'-O-methyladenosine
  modified_base 27: mod_base = OTHER; note = 2'-O-methyluridine
  modified_base 28: mod_base = OTHER; note = 2'-O-methylcytidine
  modified_base 29: mod_base = OTHER; note = 2'-O-methyladenosine
  modified_base 30: mod_base = OTHER; note = 2'-O-methyladenosine
  modified_base 31: mod_base = OTHER; note = 2'-O-methyladenosine
  modified_base 32: mod_base = OTHER; note = 2'-O-methylguanosine
  modified_base 33: mod_base = OTHER; note = 2'-O-methylcytidine
  modified_base 34: mod_base = OTHER; note = 2'-O-methyladenosine

SEQ ID NO: 944 - RNA, 34 nt, synthetic construct; identical to SEQ ID NO: 692
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylcytidine
  modified_base 4: mod_base = OTHER; note = 2'-O-methyluridine
  modified_base 5: mod_base = OTHER; note = 2'-O-methyluridine
  modified_base 6: mod_base = OTHER; note = 2'-O-methylguanosine
  modified_base 7: mod_base = OTHER; note = 2'-O-methyladenosine
  modified_base 8: mod_base = OTHER; note = 2'-O-methylguanosine
  modified_base 9: mod_base = OTHER; note = 2'-O-methylcytidine
  modified_base 10: mod_base = OTHER; note = 2'-O-methyluridine
  modified_base 11: mod_base = OTHER; note = 2'-O-methyluridine
  modified_base 12: mod_base = OTHER; note = 2'-O-methylguanosine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methylcytidine
  modified_base 16: mod_base = OTHER; note = 2'-O-methyladenosine
  modified_base 17: mod_base = OTHER; note = 2'-O-methylguanosine
  modified_base 18: mod_base = OTHER; note = 2'-O-methylguanosine
  modified_base 19: mod_base = OTHER; note = 2'-O-methylguanosine
  modified_base 20: mod_base = OTHER; note = 2'-O-methylguanosine
  modified_base 21: mod_base = OTHER; note = 2'-O-methyladenosine
  modified_base 22: mod_base = OTHER; note = 2'-fluorouridine
  modified_base 23: mod_base = OTHER; note = 2'-fluorocytidine
  modified_base 24: mod_base = OTHER; note = 2'-fluoroadenosine
  modified_base 25: mod_base = OTHER; note = 2'-O-methyladenosine
  modified_base 26: mod_base = OTHER; note = 2'-O-methylguanosine
  modified_base 27: mod_base = OTHER; note = 2'-O-methylcytidine
  modified_base 28: mod_base = OTHER; note = 2'-O-methyluridine
  modified_base 29: mod_base = OTHER; note = 2'-O-methylcytidine
  modified_base 30: mod_base = OTHER; note = 2'-O-methyladenosine
  modified_base 31: mod_base = OTHER; note = 2'-O-methyladenosine
  modified_base 32: mod_base = OTHER; note = 2'-O-methylguanosine
  modified_base 33: mod_base = OTHER; note = 2'-O-methyladenosine
  modified_base 34: mod_base = OTHER; note = 2'-O-methyladenosine

SEQ ID NO: 945 - RNA, 34 nt, synthetic construct; identical to SEQ ID NO: 693
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methylguanosine
  modified_base 4: mod_base = OTHER; note = 2'-O-methyladenosine
  modified_base 5: mod_base = OTHER; note = 2'-O-methyluridine
  modified_base 6: mod_base = OTHER; note = 2'-O-methyluridine
  modified_base 7: mod_base = OTHER; note = 2'-O-methylguanosine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methylcytidine
  modified_base 11: mod_base = OTHER; note = 2'-O-methyluridine
  modified_base 12: mod_base = OTHER; note = 2'-O-methylguanosine
  modified_base 13: mod_base = OTHER; note = 2'-O-methylcytidine
  modified_base 14: mod_base = OTHER; note = 2'-fluoroadenosine
  modified_base 15: mod_base = OTHER; note = 2'-O-methylcytidine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methyluridine
  modified_base 19: mod_base = OTHER; note = 2'-O-methylguanosine
  modified_base 20: mod_base = OTHER; note = 2'-O-methylguanosine
  modified_base 21: mod_base = OTHER; note = 2'-O-methyluridine
  modified_base 22: mod_base = OTHER; note = 2'-fluoroguanosine
  modified_base 23: mod_base = OTHER; note = 2'-fluorocytidine
  modified_base 24: mod_base = OTHER; note = 2'-fluoroadenosine
  modified_base 25: mod_base = OTHER; note = 2'-O-methylguanosine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methylcytidine
  modified_base 29: mod_base = OTHER; note = 2'-O-methyladenosine
  modified_base 30: mod_base = OTHER; note = 2'-O-methyladenosine
  modified_base 31: mod_base = OTHER; note = 2'-O-methyluridine
  modified_base 32: mod_base = OTHER; note = 2'-O-methylcytidine
  modified_base 33: mod_base = OTHER; note = 2'-O-methylcytidine
  modified_base 34: mod_base = OTHER; note = 2'-O-methyladenosine

SEQ ID NO: 946 - RNA, 34 nt, synthetic construct; identical to SEQ ID NO: 694
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methyluridine
  modified_base 5: mod_base = OTHER; note = 2'-O-methyladenosine
  modified_base 6: mod_base = OTHER; note = 2'-O-methyluridine
  modified_base 7: mod_base = OTHER; note = 2'-O-methyluridine
  modified_base 8: mod_base = OTHER; note = 2'-O-methylguanosine
  modified_base 9: mod_base = OTHER; note = 2'-O-methyladenosine
  modified_base 10: mod_base = OTHER; note = 2'-O-methylguanosine
  modified_base 11: mod_base = OTHER; note = 2'-O-methylcytidine
  modified_base 12: mod_base = OTHER; note = 2'-O-methyladenosine
  modified_base 13: mod_base = OTHER; note = 2'-O-methyluridine
  modified_base 14: mod_base = OTHER; note = 2'-fluorocytidine
  modified_base 15: mod_base = OTHER; note = 2'-O-methyluridine
  modified_base 16: mod_base = OTHER; note = 2'-O-methylcytidine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methyluridine
  modified_base 20: mod_base = OTHER; note = 2'-O-methyladenosine
  modified_base 21: mod_base = OTHER; note = 2'-O-methylguanosine
  modified_base 22: mod_base = OTHER; note = 2'-fluoroadenosine
  modified_base 23: mod_base = OTHER; note = 2'-fluorouridine
  modified_base 24: mod_base = OTHER; note = 2'-fluoroguanosine
  modified_base 25: mod_base = OTHER; note = 2'-O-methylcytidine
  modified_base 26: mod_base = OTHER; note = 2'-O-methyluridine
  modified_base 27: mod_base = OTHER; note = 2'-O-methylcytidine
  modified_base 28: mod_base = OTHER; note = 2'-O-methyladenosine
  modified_base 29: mod_base = OTHER; note = 2'-O-methyladenosine
  modified_base 30: mod_base = OTHER; note = 2'-O-methyluridine
  modified_base 31: mod_base = OTHER; note = 2'-O-methyladenosine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 947 - RNA, 34 nt, synthetic construct; identical to SEQ ID NO: 695
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyluridine
  modified_base 4: mod_base = OTHER; note = 2'-O-methylcytidine
  modified_base 5: mod_base = OTHER; note = 2'-O-methylcytidine
  modified_base 6: mod_base = OTHER; note = 2'-O-methyluridine
  modified_base 7: mod_base = OTHER; note = 2'-O-methyluridine
  modified_base 8: mod_base = OTHER; note = 2'-O-methylguanosine
  modified_base 9: mod_base = OTHER; note = 2'-O-methyladenosine
  modified_base 10: mod_base = OTHER; note = 2'-O-methylcytidine
  modified_base 11: mod_base = OTHER; note = 2'-O-methyluridine
  modified_base 12: mod_base = OTHER; note = 2'-O-methyluridine
  modified_base 13: mod_base = OTHER; note = 2'-O-methyluridine
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methylcytidine
  modified_base 20: mod_base = OTHER; note = 2'-O-methyluridine
  modified_base 21: mod_base = OTHER; note = 2'-O-methylcytidine
  modified_base 22: mod_base = OTHER; note = 2'-fluoroadenosine
  modified_base 23: mod_base = OTHER; note = 2'-fluoroadenosine
  modified_base 24: mod_base = OTHER; note = 2'-fluoroadenosine
  modified_base 25: mod_base = OTHER; note = 2'-O-methylguanosine
  modified_base 26: mod_base = OTHER; note = 2'-O-methyluridine
  modified_base 27: mod_base = OTHER; note = 2'-O-methylcytidine
  modified_base 28: mod_base = OTHER; note = 2'-O-methyladenosine
  modified_base 29: mod_base = OTHER; note = 2'-O-methyladenosine
  modified_base 30: mod_base = OTHER; note = 2'-O-methylguanosine
  modified_base 31: mod_base = OTHER; note = 2'-O-methylguanosine
  modified_base 32: mod_base = OTHER; note = 2'-O-methyladenosine
  modified_base 33: mod_base = OTHER; note = 2'-O-methyluridine
  modified_base 34: mod_base = OTHER; note = 2'-O-methyladenosine

SEQ ID NO: 948 - RNA, 34 nt, synthetic construct; identical to SEQ ID NO: 696
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methylcytidine
  modified_base 4: mod_base = OTHER; note = 2'-O-methyladenosine
  modified_base 5: mod_base = OTHER; note = 2'-O-methylguanosine
  modified_base 6: mod_base = OTHER; note = 2'-O-methyladenosine
  modified_base 7: mod_base = OTHER; note = 2'-O-methylcytidine
  modified_base 8: mod_base = OTHER; note = 2'-O-methyladenosine
  modified_base 9: mod_base = OTHER; note = 2'-O-methyluridine
  modified_base 10: mod_base = OTHER; note = 2'-O-methylcytidine
  modified_base 11: mod_base = OTHER; note = 2'-O-methylcytidine
  modified_base 12: mod_base = OTHER; note = 2'-O-methyladenosine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-O-methylcytidine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methylcytidine
  modified_base 20: mod_base = OTHER; note = 2'-O-methyluridine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluorouridine
  modified_base 24: mod_base = OTHER; note = 2'-fluoroguanosine
  modified_base 25: mod_base = OTHER; note = 2'-O-methylguanosine
  modified_base 26: mod_base = OTHER; note = 2'-O-methyladenosine
  modified_base 27: mod_base = OTHER; note = 2'-O-methyluridine
  modified_base 28: mod_base = OTHER; note = 2'-O-methylguanosine
  modified_base 29: mod_base = OTHER; note = 2'-O-methyluridine
  modified_base 30: mod_base = OTHER; note = 2'-O-methylcytidine
  modified_base 31: mod_base = OTHER; note = 2'-O-methyluridine
  modified_base 32: mod_base = OTHER; note = 2'-O-methylguanosine
  modified_base 33: mod_base = OTHER; note = 2'-O-methylcytidine
  modified_base 34: mod_base = OTHER; note = 2'-O-methyladenosine

SEQ ID NO: 949 - RNA, 34 nt, synthetic construct; identical to SEQ ID NO: 697
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylguanosine
  modified_base 4: mod_base = OTHER; note = 2'-O-methyladenosine
  modified_base 5: mod_base = OTHER; note = 2'-O-methylcytidine
  modified_base 6: mod_base = OTHER; note = 2'-O-methylcytidine
  modified_base 7: mod_base = OTHER; note = 2'-O-methyluridine
  modified_base 8: mod_base = OTHER; note = 2'-O-methylcytidine
  modified_base 9: mod_base = OTHER; note = 2'-O-methylcytidine
  modified_base 10: mod_base = OTHER; note = 2'-O-methyluridine
  modified_base 11: mod_base = OTHER; note = 2'-O-methyluridine
  modified_base 12: mod_base = OTHER; note = 2'-O-methylcytidine
  modified_base 13: mod_base = OTHER; note = 2'-O-methylcytidine
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-O-methylguanosine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methyladenosine
  modified_base 20: mod_base = OTHER; note = 2'-O-methyluridine
  modified_base 21: mod_base = OTHER; note = 2'-O-methylcytidine
  modified_base 22: mod_base = OTHER; note = 2'-fluoroguanosine
  modified_base 23: mod_base = OTHER; note = 2'-fluoroguanosine
  modified_base 24: mod_base = OTHER; note = 2'-fluoroadenosine
  modified_base 25: mod_base = OTHER; note = 2'-O-methyladenosine
  modified_base 26: mod_base = OTHER; note = 2'-O-methylguanosine
  modified_base 27: mod_base = OTHER; note = 2'-O-methylguanosine
  modified_base 28: mod_base = OTHER; note = 2'-O-methyladenosine
  modified_base 29: mod_base = OTHER; note = 2'-O-methylguanosine
  modified_base 30: mod_base = OTHER; note = 2'-O-methylguanosine
  modified_base 31: mod_base = OTHER; note = 2'-O-methyluridine
  modified_base 32: mod_base = OTHER; note = 2'-O-methylcytidine
  modified_base 33: mod_base = OTHER; note = 2'-O-methyluridine
  modified_base 34: mod_base = OTHER; note = 2'-O-methyladenosine

SEQ ID NO: 950 - RNA, 34 nt, synthetic construct; identical to SEQ ID NO: 698
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylcytidine
  modified_base 4: mod_base = OTHER; note = 2'-O-methylcytidine
  modified_base 5: mod_base = OTHER; note = 2'-O-methyluridine
  modified_base 6: mod_base = OTHER; note = 2'-O-methyluridine
  modified_base 7: mod_base = OTHER; note = 2'-O-methylcytidine
  modified_base 8: mod_base = OTHER; note = 2'-O-methyluridine
  modified_base 9: mod_base = OTHER; note = 2'-O-methylcytidine
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-O-methyluridine
  modified_base 13: mod_base = OTHER; note = 2'-O-methyluridine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-O-methylguanosine
  modified_base 17: mod_base = OTHER; note = 2'-O-methyluridine
  modified_base 18: mod_base = OTHER; note = 2'-O-methyluridine
  modified_base 19: mod_base = OTHER; note = 2'-O-methylguanosine
  modified_base 20: mod_base = OTHER; note = 2'-O-methyluridine
  modified_base 21: mod_base = OTHER; note = 2'-O-methyluridine
  modified_base 22: mod_base = OTHER; note = 2'-fluoroadenosine
  modified_base 23: mod_base = OTHER; note = 2'-fluoroadenosine
  modified_base 24: mod_base = OTHER; note = 2'-fluorouridine
  modified_base 25: mod_base = OTHER; note = 2'-O-methyluridine
  modified_base 26: mod_base = OTHER; note = 2'-O-methylguanosine
  modified_base 27: mod_base = OTHER; note = 2'-O-methyladenosine
  modified_base 28: mod_base = OTHER; note = 2'-O-methylguanosine
  modified_base 29: mod_base = OTHER; note = 2'-O-methyladenosine
  modified_base 30: mod_base = OTHER; note = 2'-O-methyladenosine
  modified_base 31: mod_base = OTHER; note = 2'-O-methylguanosine
  modified_base 32: mod_base = OTHER; note = 2'-O-methylguanosine
  modified_base 33: mod_base = OTHER; note = 2'-O-methyluridine
  modified_base 34: mod_base = OTHER; note = 2'-O-methyladenosine

SEQ ID NO: 951 - RNA, 34 nt, synthetic construct; identical to SEQ ID NO: 699
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylguanosine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methylguanosine
  modified_base 7: mod_base = OTHER; note = 2'-O-methyluridine
  modified_base 8: mod_base = OTHER; note = 2'-O-methylcytidine
  modified_base 9: mod_base = OTHER; note = 2'-O-methylguanosine
  modified_base 10: mod_base = OTHER; note = 2'-O-methylguanosine
  modified_base 11: mod_base = OTHER; note = 2'-O-methyladenosine
  modified_base 12: mod_base = OTHER; note = 2'-O-methyladenosine
  modified_base 13: mod_base = OTHER; note = 2'-O-methylguanosine
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-O-methylguanosine
  modified_base 17: mod_base = OTHER; note = 2'-O-methylcytidine
  modified_base 18: mod_base = OTHER; note = 2'-O-methylcytidine
  modified_base 19: mod_base = OTHER; note = 2'-O-methylguanosine
  modified_base 20: mod_base = OTHER; note = 2'-O-methyluridine
  modified_base 21: mod_base = OTHER; note = 2'-O-methylcytidine
  modified_base 22: mod_base = OTHER; note = 2'-fluorocytidine
  modified_base 23: mod_base = OTHER; note = 2'-fluorouridine
  modified_base 24: mod_base = OTHER; note = 2'-fluorouridine
  modified_base 25: mod_base = OTHER; note = 2'-O-methylcytidine
  modified_base 26: mod_base = OTHER; note = 2'-O-methylcytidine
  modified_base 27: mod_base = OTHER; note = 2'-O-methylguanosine
  modified_base 28: mod_base = OTHER; note = 2'-O-methyladenosine
  modified_base 29: mod_base = OTHER; note = 2'-O-methylcytidine
  modified_base 30: mod_base = OTHER; note = 2'-O-methyluridine
  modified_base 31: mod_base = OTHER; note = 2'-O-methyluridine
  modified_base 32: mod_base = OTHER; note = 2'-O-methylcytidine
  modified_base 33: mod_base = OTHER; note = 2'-O-methyluridine
  modified_base 34: mod_base = OTHER; note = 2'-O-methyladenosine

SEQ ID NO: 952 - RNA, 34 nt, synthetic construct; identical to SEQ ID NO: 700
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylguanosine
  modified_base 4: mod_base = OTHER; note = 2'-O-methylcytidine
  modified_base 5: mod_base = OTHER; note = 2'-O-methyladenosine
  modified_base 6: mod_base = OTHER; note = 2'-O-methylcytidine
  modified_base 7: mod_base = OTHER; note = 2'-O-methyladenosine
  modified_base 8: mod_base = OTHER; note = 2'-O-methylguanosine
  modified_base 9: mod_base = OTHER; note = 2'-O-methylguanosine
  modified_base 10: mod_base = OTHER; note = 2'-O-methylguanosine
  modified_base 11: mod_base = OTHER; note = 2'-O-methyluridine
  modified_base 12: mod_base = OTHER; note = 2'-O-methyladenosine
  modified_base 13: mod_base = OTHER; note = 2'-O-methylcytidine
  modified_base 14: mod_base = OTHER; note = 2'-fluoroguanosine
  modified_base 15: mod_base = OTHER; note = 2'-O-methylguanosine
  modified_base 16: mod_base = OTHER; note = 2'-O-methylguanosine
  modified_base 17: mod_base = OTHER; note = 2'-O-methyluridine
  modified_base 18: mod_base = OTHER; note = 2'-O-methyladenosine
  modified_base 19: mod_base = OTHER; note = 2'-O-methylguanosine
  modified_base 20: mod_base = OTHER; note = 2'-O-methylcytidine
  modified_base 21: mod_base = OTHER; note = 2'-O-methylcytidine
  modified_base 22: mod_base = OTHER; note = 2'-fluoroguanosine
  modified_base 23: mod_base = OTHER; note = 2'-fluorouridine
  modified_base 24: mod_base = OTHER; note = 2'-fluoroadenosine
  modified_base 25: mod_base = OTHER; note = 2'-O-methylcytidine
  modified_base 26: mod_base = OTHER; note = 2'-O-methylcytidine
  modified_base 27: mod_base = OTHER; note = 2'-O-methylcytidine
  modified_base 28: mod_base = OTHER; note = 2'-O-methyluridine
  modified_base 29: mod_base = OTHER; note = 2'-O-methylguanosine
  modified_base 30: mod_base = OTHER; note = 2'-O-methyluridine
  modified_base 31: mod_base = OTHER; note = 2'-O-methylguanosine
  modified_base 32: mod_base = OTHER; note = 2'-O-methylcytidine
  modified_base 33: mod_base = OTHER; note = 2'-O-methyladenosine
  modified_base 34: mod_base = OTHER; note = 2'-O-methyladenosine

SEQ ID NO: 953 - RNA, 34 nt, synthetic construct; identical to SEQ ID NO: 701
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyluridine
  modified_base 4: mod_base = OTHER; note = 2'-O-methylguanosine
  modified_base 5: mod_base = OTHER; note = 2'-O-methyladenosine
  modified_base 6: mod_base = OTHER; note = 2'-O-methylcytidine
  modified_base 7: mod_base = OTHER; note = 2'-O-methyladenosine
  modified_base 8: mod_base = OTHER; note = 2'-O-methylguanosine
  modified_base 9: mod_base = OTHER; note = 2'-O-methyluridine
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-O-methyluridine
  modified_base 13: mod_base = OTHER; note = 2'-O-methyluridine
  modified_base 14: mod_base = OTHER; note = 2'-fluoroguanosine
  modified_base 15: mod_base = OTHER; note = 2'-O-methylguanosine
  modified_base 16: mod_base = OTHER; note = 2'-O-methylguanosine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methylcytidine
  modified_base 20: mod_base = OTHER; note = 2'-O-methylcytidine
  modified_base 21: mod_base = OTHER; note = 2'-O-methylcytidine
  modified_base 22: mod_base = OTHER; note = 2'-fluoroadenosine
  modified_base 23: mod_base = OTHER; note = 2'-fluoroadenosine
  modified_base 24: mod_base = OTHER; note = 2'-fluorouridine
  modified_base 25: mod_base = OTHER; note = 2'-O-methyluridine
  modified_base 26: mod_base = OTHER; note = 2'-O-methyladenosine
  modified_base 27: mod_base = OTHER; note = 2'-O-methylcytidine
  modified_base 28: mod_base = OTHER; note = 2'-O-methyluridine
  modified_base 29: mod_base = OTHER; note = 2'-O-methylguanosine
  modified_base 30: mod_base = OTHER; note = 2'-O-methyluridine
  modified_base 31: mod_base = OTHER; note = 2'-O-methylcytidine
  modified_base 32: mod_base = OTHER; note = 2'-O-methyladenosine
  modified_base 33: mod_base = OTHER; note = 2'-O-methyluridine
  modified_base 34: mod_base = OTHER; note = 2'-O-methyladenosine

SEQ ID NO: 954 - RNA, 34 nt, synthetic construct; identical to SEQ ID NO: 702
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methyluridine
  modified_base 4: mod_base = OTHER; note = 2'-O-methyluridine
  modified_base 5: mod_base = OTHER; note = 2'-O-methyladenosine
  modified_base 6: mod_base = OTHER; note = 2'-O-methylguanosine
  modified_base 7: mod_base = OTHER; note = 2'-O-methyluridine
  modified_base 8: mod_base = OTHER; note = 2'-O-methylcytidine
  modified_base 9: mod_base = OTHER; note = 2'-O-methylcytidine
  modified_base 10: mod_base = OTHER; note = 2'-O-methylcytidine
  modified_base 11: mod_base = OTHER; note = 2'-O-methyluridine
  modified_base 12: mod_base = OTHER; note = 2'-O-methylguanosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyluridine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methylguanosine
  modified_base 22: mod_base = OTHER; note = 2'-fluorouridine
  modified_base 23: mod_base = OTHER; note = 2'-fluorocytidine
  modified_base 24: mod_base = OTHER; note = 2'-fluoroadenosine
  modified_base 25: mod_base = OTHER; note = 2'-O-methylguanosine
  modified_base 26: mod_base = OTHER; note = 2'-O-methylguanosine
  modified_base 27: mod_base = OTHER; note = 2'-O-methylguanosine
  modified_base 28: mod_base = OTHER; note = 2'-O-methyladenosine
  modified_base 29: mod_base = OTHER; note = 2'-O-methylcytidine
  modified_base 30: mod_base = OTHER; note = 2'-O-methyluridine
  modified_base 31: mod_base = OTHER; note = 2'-O-methyladenosine
  modified_base 32: mod_base = OTHER; note = 2'-O-methyladenosine
  modified_base 33: mod_base = OTHER; note = 2'-O-methylcytidine
  modified_base 34: mod_base = OTHER; note = 2'-O-methyladenosine

SEQ ID NO: 955 - RNA, 34 nt, synthetic construct; identical to SEQ ID NO: 703
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyluridine
  modified_base 4: mod_base = OTHER; note = 2'-O-methyladenosine
  modified_base 5: mod_base = OTHER; note = 2'-O-methyluridine
  modified_base 6: mod_base = OTHER; note = 2'-O-methylcytidine
  modified_base 7: mod_base = OTHER; note = 2'-O-methylcytidine
  modified_base 8: mod_base = OTHER; note = 2'-O-methyluridine
  modified_base 9: mod_base = OTHER; note = 2'-O-methyluridine
  modified_base 10: mod_base = OTHER; note = 2'-O-methylguanosine
  modified_base 11: mod_base = OTHER; note = 2'-O-methyladenosine
  modified_base 12: mod_base = OTHER; note = 2'-O-methylcytidine
  modified_base 13: mod_base = OTHER; note = 2'-O-methyluridine
  modified_base 14: mod_base = OTHER; note = 2'-fluorouridine
  modified_base 15: mod_base = OTHER; note = 2'-O-methyluridine
  modified_base 16: mod_base = OTHER; note = 2'-O-methylguanosine
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methylcytidine
  modified_base 20: mod_base = OTHER; note = 2'-O-methyladenosine
  modified_base 21: mod_base = OTHER; note = 2'-O-methyladenosine
  modified_base 22: mod_base = OTHER; note = 2'-fluoroadenosine
  modified_base 23: mod_base = OTHER; note = 2'-fluoroguanosine
  modified_base 24: mod_base = OTHER; note = 2'-fluorouridine
  modified_base 25: mod_base = OTHER; note = 2'-O-methylcytidine
  modified_base 26: mod_base = OTHER; note = 2'-O-methyladenosine
  modified_base 27: mod_base = OTHER; note = 2'-O-methyladenosine
  modified_base 28: mod_base = OTHER; note = 2'-O-methylguanosine
  modified_base 29: mod_base = OTHER; note = 2'-O-methylguanosine
  modified_base 30: mod_base = OTHER; note = 2'-O-methyladenosine
  modified_base 31: mod_base = OTHER; note = 2'-O-methyluridine
  modified_base 32: mod_base = OTHER; note = 2'-O-methyladenosine
  modified_base 33: mod_base = OTHER; note = 2'-O-methyluridine
  modified_base 34: mod_base = OTHER; note = 2'-O-methyladenosine

SEQ ID NO: 956 - RNA, 34 nt, synthetic construct; identical to SEQ ID NO: 704
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methyluridine
  modified_base 4: mod_base = OTHER; note = 2'-O-methyladenosine
  modified_base 5: mod_base = OTHER; note = 2'-O-methylcytidine
  modified_base 6: mod_base = OTHER; note = 2'-O-methylguanosine
  modified_base 7: mod_base = OTHER; note = 2'-O-methyluridine
  modified_base 8: mod_base = OTHER; note = 2'-O-methylguanosine
  modified_base 9: mod_base = OTHER; note = 2'-O-methyluridine
  modified_base 10: mod_base = OTHER; note = 2'-O-methylcytidine
  modified_base 11: mod_base = OTHER; note = 2'-O-methyluridine
  modified_base 12: mod_base = OTHER; note = 2'-O-methylguanosine
  modified_base 13: mod_base = OTHER; note = 2'-O-methylcytidine
  modified_base 14: mod_base = OTHER; note = 2'-fluoroadenosine
  modified_base 15: mod_base = OTHER; note = 2'-O-methylcytidine
  modified_base 16: mod_base = OTHER; note = 2'-O-methyladenosine
  modified_base 17: mod_base = OTHER; note = 2'-O-methylguanosine
  modified_base 18: mod_base = OTHER; note = 2'-O-methylguanosine
  modified_base 19: mod_base = OTHER; note = 2'-O-methylguanosine
  modified_base 20: mod_base = OTHER; note = 2'-O-methylguanosine
  modified_base 21: mod_base = OTHER; note = 2'-O-methyluridine
  modified_base 22: mod_base = OTHER; note = 2'-fluoroguanosine
  modified_base 23: mod_base = OTHER; note = 2'-fluorocytidine
  modified_base 24: mod_base = OTHER; note = 2'-fluoroadenosine
  modified_base 25: mod_base = OTHER; note = 2'-O-methylguanosine
  modified_base 26: mod_base = OTHER; note = 2'-O-methyladenosine
  modified_base 27: mod_base = OTHER; note = 2'-O-methylcytidine
  modified_base 28: mod_base = OTHER; note = 2'-O-methyladenosine
  modified_base 29: mod_base = OTHER; note = 2'-O-methylcytidine
  modified_base 30: mod_base = OTHER; note = 2'-O-methylguanosine
  modified_base 31: mod_base = OTHER; note = 2'-O-methyluridine
  modified_base 32: mod_base = OTHER; note = 2'-O-methyladenosine
  modified_base 33: mod_base = OTHER; note = 2'-O-methylcytidine
  modified_base 34: mod_base = OTHER; note = 2'-O-methyladenosine

SEQ ID NO: 957 - RNA, 34 nt, synthetic construct; identical to SEQ ID NO: 705
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methyluridine
  modified_base 4: mod_base = OTHER; note = 2'-O-methylcytidine
  modified_base 5: mod_base = OTHER; note = 2'-O-methyladenosine
  modified_base 6: mod_base = OTHER; note = 2'-O-methylguanosine
  modified_base 7: mod_base = OTHER; note = 2'-O-methylcytidine
  modified_base 8: mod_base = OTHER; note = 2'-O-methyladenosine
  modified_base 9: mod_base = OTHER; note = 2'-O-methylcytidine
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-O-methyladenosine
  modified_base 13: mod_base = OTHER; note = 2'-O-methylguanosine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-O-methylcytidine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methyladenosine
  modified_base 20: mod_base = OTHER; note = 2'-O-methyluridine
  modified_base 21: mod_base = OTHER; note = 2'-O-methyladenosine
  modified_base 22: mod_base = OTHER; note = 2'-fluorocytidine
  modified_base 23: mod_base = OTHER; note = 2'-fluorouridine
  modified_base 24: mod_base = OTHER; note = 2'-fluorouridine
  modified_base 25: mod_base = OTHER; note = 2'-O-methyluridine
  modified_base 26: mod_base = OTHER; note = 2'-O-methylguanosine
  modified_base 27: mod_base = OTHER; note = 2'-O-methyluridine
  modified_base 28: mod_base = OTHER; note = 2'-O-methylguanosine
  modified_base 29: mod_base = OTHER; note = 2'-O-methylcytidine
  modified_base 30: mod_base = OTHER; note = 2'-O-methyluridine
  modified_base 31: mod_base = OTHER; note = 2'-O-methylguanosine
  modified_base 32: mod_base = OTHER; note = 2'-O-methyladenosine
  modified_base 33: mod_base = OTHER; note = 2'-O-methylcytidine
  modified_base 34: mod_base = OTHER; note = 2'-O-methyladenosine

SEQ ID NO: 958 - RNA, 34 nt, synthetic construct; identical to SEQ ID NO: 706
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylguanosine
  modified_base 4: mod_base = OTHER; note = 2'-O-methylguanosine
  modified_base 5: mod_base = OTHER; note = 2'-O-methyluridine
  modified_base 6: mod_base = OTHER; note = 2'-O-methylcytidine
  modified_base 7: mod_base = OTHER; note = 2'-O-methyluridine
  modified_base 8: mod_base = OTHER; note = 2'-O-methyluridine
  modified_base 9: mod_base = OTHER; note = 2'-O-methylcytidine
  modified_base 10: mod_base = OTHER; note = 2'-O-methyladenosine
  modified_base 11: mod_base = OTHER; note = 2'-O-methyluridine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyluridine
  modified_base 16: mod_base = OTHER; note = 2'-O-methylguanosine
  modified_base 17: mod_base = OTHER; note = 2'-O-methyladenosine
  modified_base 18: mod_base = OTHER; note = 2'-O-methyluridine
  modified_base 19: mod_base = OTHER; note = 2'-O-methyluridine
  modified_base 20: mod_base = OTHER; note = 2'-O-methyladenosine
  modified_base 21: mod_base = OTHER; note = 2'-O-methyladenosine
  modified_base 22: mod_base = OTHER; note = 2'-fluorouridine
  modified_base 23: mod_base = OTHER; note = 2'-fluorouridine
  modified_base 24: mod_base = OTHER; note = 2'-fluoroadenosine
  modified_base 25: mod_base = OTHER; note = 2'-O-methyluridine
  modified_base 26: mod_base = OTHER; note = 2'-O-methylguanosine
  modified_base 27: mod_base = OTHER; note = 2'-O-methyladenosine
  modified_base 28: mod_base = OTHER; note = 2'-O-methyladenosine
  modified_base 29: mod_base = OTHER; note = 2'-O-methylguanosine
  modified_base 30: mod_base = OTHER; note = 2'-O-methyladenosine
  modified_base 31: mod_base = OTHER; note = 2'-O-methylcytidine
  modified_base 32: mod_base = OTHER; note = 2'-O-methylcytidine
  modified_base 33: mod_base = OTHER; note = 2'-O-methyladenosine
  modified_base 34: mod_base = OTHER; note = 2'-O-methyladenosine

SEQ ID NO: 959 - RNA, 34 nt, synthetic construct; identical to SEQ ID NO: 707
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methylguanosine
  modified_base 5: mod_base = OTHER; note = 2'-O-methyladenosine
  modified_base 6: mod_base = OTHER; note = 2'-O-methylguanosine
  modified_base 7: mod_base = OTHER; note = 2'-O-methyladenosine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methylcytidine
  modified_base 11: mod_base = OTHER; note = 2'-O-methyladenosine
  modified_base 12: mod_base = OTHER; note = 2'-O-methylguanosine
  modified_base 13: mod_base = OTHER; note = 2'-O-methyladenosine
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-O-methylcytidine
  modified_base 17: mod_base = OTHER; note = 2'-O-methyluridine
  modified_base 18: mod_base = OTHER; note = 2'-O-methylguanosine
  modified_base 19: mod_base = OTHER; note = 2'-O-methylguanosine
  modified_base 20: mod_base = OTHER; note = 2'-O-methyluridine
  modified_base 21: mod_base = OTHER; note = 2'-O-methylcytidine
  modified_base 22: mod_base = OTHER; note = 2'-fluorouridine
  modified_base 23: mod_base = OTHER; note = 2'-fluorocytidine
  modified_base 24: mod_base = OTHER; note = 2'-fluorouridine
  modified_base 25: mod_base = OTHER; note = 2'-O-methylguanosine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methyluridine
  modified_base 29: mod_base = OTHER; note = 2'-O-methylcytidine
  modified_base 30: mod_base = OTHER; note = 2'-O-methyluridine
  modified_base 31: mod_base = OTHER; note = 2'-O-methylcytidine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 960 - RNA, 34 nt, synthetic construct; identical to SEQ ID NO: 708
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methyladenosine
  modified_base 4: mod_base = OTHER; note = 2'-O-methylguanosine
  modified_base 5: mod_base = OTHER; note = 2'-O-methyladenosine
  modified_base 6: mod_base = OTHER; note = 2'-O-methylcytidine
  modified_base 7: mod_base = OTHER; note = 2'-O-methyladenosine
  modified_base 8: mod_base = OTHER; note = 2'-O-methyluridine
  modified_base 9: mod_base = OTHER; note = 2'-O-methylcytidine
  modified_base 10: mod_base = OTHER; note = 2'-O-methylcytidine
  modified_base 11: mod_base = OTHER; note = 2'-O-methyladenosine
  modified_base 12: mod_base = OTHER; note = 2'-O-methylguanosine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methylcytidine
  modified_base 20: mod_base = OTHER; note = 2'-O-methyluridine
  modified_base 21: mod_base = OTHER; note = 2'-O-methyladenosine
  modified_base 22: mod_base = OTHER; note = 2'-fluorouridine
  modified_base 23: mod_base = OTHER; note = 2'-fluorocytidine
  modified_base 24: mod_base = OTHER; note = 2'-fluorouridine
  modified_base 25: mod_base = OTHER; note = 2'-O-methylguanosine
  modified_base 26: mod_base = OTHER; note = 2'-O-methylguanosine
  modified_base 27: mod_base = OTHER; note = 2'-O-methyladenosine
  modified_base 28: mod_base = OTHER; note = 2'-O-methyluridine
  modified_base 29: mod_base = OTHER; note = 2'-O-methylguanosine
  modified_base 30: mod_base = OTHER; note = 2'-O-methyluridine
  modified_base 31: mod_base = OTHER; note = 2'-O-methylcytidine
  modified_base 32: mod_base = OTHER; note = 2'-O-methyluridine
  modified_base 33: mod_base = OTHER; note = 2'-O-methyladenosine
  modified_base 34: mod_base = OTHER; note = 2'-O-methyladenosine

SEQ ID NO: 961 - RNA, 34 nt, synthetic construct; identical to SEQ ID NO: 709
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyluridine
  modified_base 4: mod_base = OTHER; note = 2'-O-methylcytidine
  modified_base 5: mod_base = OTHER; note = 2'-O-methylcytidine
  modified_base 6: mod_base = OTHER; note = 2'-O-methyluridine
  modified_base 7: mod_base = OTHER; note = 2'-O-methyluridine
  modified_base 8: mod_base = OTHER; note = 2'-O-methylcytidine
  modified_base 9: mod_base = OTHER; note = 2'-O-methylcytidine
  modified_base 10: mod_base = OTHER; note = 2'-O-methylguanosine
  modified_base 11: mod_base = OTHER; note = 2'-O-methyladenosine
  modified_base 12: mod_base = OTHER; note = 2'-O-methylguanosine
  modified_base 13: mod_base = OTHER; note = 2'-O-methyluridine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-O-methylguanosine
  modified_base 17: mod_base = OTHER; note = 2'-O-methylcytidine
  modified_base 18: mod_base = OTHER; note = 2'-O-methyluridine
  modified_base 19: mod_base = OTHER; note = 2'-O-methyluridine
  modified_base 20: mod_base = OTHER; note = 2'-O-methyluridine
  modified_base 21: mod_base = OTHER; note = 2'-O-methylguanosine
  modified_base 22: mod_base = OTHER; note = 2'-fluoroadenosine
  modified_base 23: mod_base = OTHER; note = 2'-fluorocytidine
  modified_base 24: mod_base = OTHER; note = 2'-fluorouridine
  modified_base 25: mod_base = OTHER; note = 2'-O-methylcytidine
  modified_base 26: mod_base = OTHER; note = 2'-O-methylguanosine
  modified_base 27: mod_base = OTHER; note = 2'-O-methylguanosine
  modified_base 28: mod_base = OTHER; note = 2'-O-methyladenosine
  modified_base 29: mod_base = OTHER; note = 2'-O-methyladenosine
  modified_base 30: mod_base = OTHER; note = 2'-O-methylguanosine
  modified_base 31: mod_base = OTHER; note = 2'-O-methylguanosine
  modified_base 32: mod_base = OTHER; note = 2'-O-methyladenosine
  modified_base 33: mod_base = OTHER; note = 2'-O-methylguanosine
  modified_base 34: mod_base = OTHER; note = 2'-O-methyladenosine

SEQ ID NO: 962 - RNA, 34 nt, synthetic construct; identical to SEQ ID NO: 710
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methyluridine
  modified_base 5: mod_base = OTHER; note = 2'-O-methylguanosine
  modified_base 6: mod_base = OTHER; note = 2'-O-methylguanosine
  modified_base 7: mod_base = OTHER; note = 2'-O-methyladenosine
  modified_base 8: mod_base = OTHER; note = 2'-O-methylguanosine
  modified_base 9: mod_base = OTHER; note = 2'-O-methylcytidine
  modified_base 10: mod_base = OTHER; note = 2'-O-methylcytidine
  modified_base 11: mod_base = OTHER; note = 2'-O-methyluridine
  modified_base 12: mod_base = OTHER; note = 2'-O-methylguanosine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methylguanosine
  modified_base 16: mod_base = OTHER; note = 2'-O-methylguanosine
  modified_base 17: mod_base = OTHER; note = 2'-O-methylguanosine
  modified_base 18: mod_base = OTHER; note = 2'-O-methyluridine
  modified_base 19: mod_base = OTHER; note = 2'-O-methylcytidine
  modified_base 20: mod_base = OTHER; note = 2'-O-methylcytidine
  modified_base 21: mod_base = OTHER; note = 2'-O-methyluridine
  modified_base 22: mod_base = OTHER; note = 2'-fluorouridine
  modified_base 23: mod_base = OTHER; note = 2'-fluorocytidine
  modified_base 24: mod_base = OTHER; note = 2'-fluoroadenosine
  modified_base 25: mod_base = OTHER; note = 2'-O-methylguanosine
  modified_base 26: mod_base = OTHER; note = 2'-O-methylguanosine
  modified_base 27: mod_base = OTHER; note = 2'-O-methylcytidine
  modified_base 28: mod_base = OTHER; note = 2'-O-methyluridine
  modified_base 29: mod_base = OTHER; note = 2'-O-methylcytidine
  modified_base 30: mod_base = OTHER; note = 2'-O-methylcytidine
  modified_base 31: mod_base = OTHER; note = 2'-O-methyladenosine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 963 - RNA, 34 nt, synthetic construct; identical to SEQ ID NO: 711
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylguanosine
  modified_base 4: mod_base = OTHER; note = 2'-O-methylguanosine
  modified_base 5: mod_base = OTHER; note = 2'-O-methylcytidine
  modified_base 6: mod_base = OTHER; note = 2'-O-methyladenosine
  modified_base 7: mod_base = OTHER; note = 2'-O-methyluridine
  modified_base 8: mod_base = OTHER; note = 2'-O-methyladenosine
  modified_base 9: mod_base = OTHER; note = 2'-O-methyluridine
  modified_base 10: mod_base = OTHER; note = 2'-O-methylguanosine
  modified_base 11: mod_base = OTHER; note = 2'-O-methyluridine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyluridine
  modified_base 16: mod_base = OTHER; note = 2'-O-methyladenosine
  modified_base 17: mod_base = OTHER; note = 2'-O-methylguanosine
  modified_base 18: mod_base = OTHER; note = 2'-O-methyladenosine
  modified_base 19: mod_base = OTHER; note = 2'-O-methylcytidine
  modified_base 20: mod_base = OTHER; note = 2'-O-methyladenosine
  modified_base 21: mod_base = OTHER; note = 2'-O-methylguanosine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluoroadenosine
  modified_base 25: mod_base = OTHER; note = 2'-O-methylcytidine
  modified_base 26: mod_base = OTHER; note = 2'-O-methyladenosine
  modified_base 27: mod_base = OTHER; note = 2'-O-methyluridine
  modified_base 28: mod_base = OTHER; note = 2'-O-methyladenosine
  modified_base 29: mod_base = OTHER; note = 2'-O-methyluridine
  modified_base 30: mod_base = OTHER; note = 2'-O-methylguanosine
  modified_base 31: mod_base = OTHER; note = 2'-O-methylcytidine
  modified_base 32: mod_base = OTHER; note = 2'-O-methylcytidine
  modified_base 33: mod_base = OTHER; note = 2'-O-methyladenosine
  modified_base 34: mod_base = OTHER; note = 2'-O-methyladenosine

SEQ ID NO: 964 - RNA, 34 nt, synthetic construct; identical to SEQ ID NO: 712
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-O-methylguanosine
  modified_base 5: mod_base = OTHER; note = 2'-O-methylcytidine
  modified_base 6: mod_base = OTHER; note = 2'-O-methyladenosine
  modified_base 7: mod_base = OTHER; note = 2'-O-methyluridine
  modified_base 8: mod_base = OTHER; note = 2'-O-methyluridine
  modified_base 9: mod_base = OTHER; note = 2'-O-methylguanosine
  modified_base 10: mod_base = OTHER; note = 2'-O-methyladenosine
  modified_base 11: mod_base = OTHER; note = 2'-O-methyluridine
  modified_base 12: mod_base = OTHER; note = 2'-O-methylguanosine
  modified_base 13: mod_base = OTHER; note = 2'-O-methyluridine
  modified_base 14: mod_base = OTHER; note = 2'-fluorouridine
  modified_base 15: mod_base = OTHER; note = 2'-O-methylcytidine
  modified_base 16: mod_base = OTHER; note = 2'-O-methyladenosine
  modified_base 17: mod_base = OTHER; note = 2'-O-methylcytidine
  modified_base 18: mod_base = OTHER; note = 2'-O-methyluridine
  modified_base 19: mod_base = OTHER; note = 2'-O-methyluridine
  modified_base 20: mod_base = OTHER; note = 2'-O-methylguanosine
  modified_base 21: mod_base = OTHER; note = 2'-O-methyladenosine
  modified_base 22: mod_base = OTHER; note = 2'-fluoroadenosine
  modified_base 23: mod_base = OTHER; note = 2'-fluorocytidine
  modified_base 24: mod_base = OTHER; note = 2'-fluoroadenosine
  modified_base 25: mod_base = OTHER; note = 2'-O-methyluridine
  modified_base 26: mod_base = OTHER; note = 2'-O-methylcytidine
  modified_base 27: mod_base = OTHER; note = 2'-O-methyladenosine
  modified_base 28: mod_base = OTHER; note = 2'-O-methyladenosine
  modified_base 29: mod_base = OTHER; note = 2'-O-methyluridine
  modified_base 30: mod_base = OTHER; note = 2'-O-methylguanosine
  modified_base 31: mod_base = OTHER; note = 2'-O-methylcytidine
  modified_base 32: mod_base = OTHER; note = 2'-O-methyluridine
  modified_base 33: mod_base = OTHER; note = 2'-O-methyluridine
  modified_base 34: mod_base = OTHER; note = 2'-O-methyladenosine

SEQ ID NO: 965 - RNA, 34 nt, synthetic construct; identical to SEQ ID NO: 713
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyluridine
  modified_base 4: mod_base = OTHER; note = 2'-O-methylcytidine
  modified_base 5: mod_base = OTHER; note = 2'-O-methyladenosine
  modified_base 6: mod_base = OTHER; note = 2'-O-methylcytidine
  modified_base 7: mod_base = OTHER; note = 2'-O-methyluridine
  modified_base 8: mod_base = OTHER; note = 2'-O-methylcytidine
  modified_base 9: mod_base = OTHER; note = 2'-O-methylcytidine
  modified_base 10: mod_base = OTHER; note = 2'-O-methyluridine
  modified_base 11: mod_base = OTHER; note = 2'-O-methylcytidine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluoroguanosine
  modified_base 15: mod_base = OTHER; note = 2'-O-methyluridine
  modified_base 16: mod_base = OTHER; note = 2'-O-methyladenosine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methylcytidine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluoroguanosine
  modified_base 25: mod_base = OTHER; note = 2'-O-methyladenosine
  modified_base 26: mod_base = OTHER; note = 2'-O-methylguanosine
  modified_base 27: mod_base = OTHER; note = 2'-O-methylguanosine
  modified_base 28: mod_base = OTHER; note = 2'-O-methyladenosine
  modified_base 29: mod_base = OTHER; note = 2'-O-methylguanosine
  modified_base 30: mod_base = OTHER; note = 2'-O-methyluridine
  modified_base 31: mod_base = OTHER; note = 2'-O-methylguanosine
  modified_base 32: mod_base = OTHER; note = 2'-O-methyladenosine
  modified_base 33: mod_base = OTHER; note = 2'-O-methylguanosine
  modified_base 34: mod_base = OTHER; note = 2'-O-methyladenosine

SEQ ID NO: 966 - RNA, 34 nt, synthetic construct; identical to SEQ ID NO: 714
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-O-methyluridine
  modified_base 5: mod_base = OTHER; note = 2'-O-methylguanosine
  modified_base 6: mod_base = OTHER; note = 2'-O-methyluridine
  modified_base 7: mod_base = OTHER; note = 2'-O-methylcytidine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methyluridine
  modified_base 11: mod_base = OTHER; note = 2'-O-methylguanosine
  modified_base 12: mod_base = OTHER; note = 2'-O-methyladenosine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methyluridine
  modified_base 16: mod_base = OTHER; note = 2'-O-methyluridine
  modified_base 17: mod_base = OTHER; note = 2'-O-methylguanosine
  modified_base 18: mod_base = OTHER; note = 2'-O-methyluridine
  modified_base 19: mod_base = OTHER; note = 2'-O-methylcytidine
  modified_base 20: mod_base = OTHER; note = 2'-O-methyladenosine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluorouridine
  modified_base 24: mod_base = OTHER; note = 2'-fluorocytidine
  modified_base 25: mod_base = OTHER; note = 2'-O-methyladenosine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methylguanosine
  modified_base 29: mod_base = OTHER; note = 2'-O-methyladenosine
  modified_base 30: mod_base = OTHER; note = 2'-O-methylcytidine
  modified_base 31: mod_base = OTHER; note = 2'-O-methyladenosine
  modified_base 32: mod_base = OTHER; note = 2'-O-methyluridine
  modified_base 33: mod_base = OTHER; note = 2'-O-methylcytidine
  modified_base 34: mod_base = OTHER; note = 2'-O-methyladenosine

SEQ ID NO: 967 - RNA, 34 nt, synthetic construct; identical to SEQ ID NO: 715
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylguanosine
  modified_base 4: mod_base = OTHER; note = 2'-O-methyluridine
  modified_base 5: mod_base = OTHER; note = 2'-O-methyluridine
  modified_base 6: mod_base = OTHER; note = 2'-O-methyluridine
  modified_base 7: mod_base = OTHER; note = 2'-O-methyluridine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyluridine
  modified_base 11: mod_base = OTHER; note = 2'-O-methyluridine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyluridine
  modified_base 16: mod_base = OTHER; note = 2'-O-methylcytidine
  modified_base 17: mod_base = OTHER; note = 2'-O-methylcytidine
  modified_base 18: mod_base = OTHER; note = 2'-O-methylcytidine
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyluridine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluoroadenosine
  modified_base 25: mod_base = OTHER; note = 2'-O-methyladenosine
  modified_base 26: mod_base = OTHER; note = 2'-O-methyluridine
  modified_base 27: mod_base = OTHER; note = 2'-O-methyluridine
  modified_base 28: mod_base = OTHER; note = 2'-O-methyladenosine
  modified_base 29: mod_base = OTHER; note = 2'-O-methyladenosine
  modified_base 30: mod_base = OTHER; note = 2'-O-methyladenosine
  modified_base 31: mod_base = OTHER; note = 2'-O-methyladenosine
  modified_base 32: mod_base = OTHER; note = 2'-O-methylcytidine
  modified_base 33: mod_base = OTHER; note = 2'-O-methyladenosine
  modified_base 34: mod_base = OTHER; note = 2'-O-methyladenosine

SEQ ID NO: 968 - RNA, 34 nt, synthetic construct; identical to SEQ ID NO: 716
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methyladenosine
  modified_base 4: mod_base = OTHER; note = 2'-O-methylguanosine
  modified_base 5: mod_base = OTHER; note = 2'-O-methyladenosine
  modified_base 6: mod_base = OTHER; note = 2'-O-methyluridine
  modified_base 7: mod_base = OTHER; note = 2'-O-methylguanosine
  modified_base 8: mod_base = OTHER; note = 2'-O-methyluridine
  modified_base 9: mod_base = OTHER; note = 2'-O-methyluridine
  modified_base 10: mod_base = OTHER; note = 2'-O-methylcytidine
  modified_base 11: mod_base = OTHER; note = 2'-O-methyladenosine
  modified_base 12: mod_base = OTHER; note = 2'-O-methyluridine
  modified_base 13: mod_base = OTHER; note = 2'-O-methylguanosine
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-O-methylguanosine
  modified_base 17: mod_base = OTHER; note = 2'-O-methylcytidine
  modified_base 18: mod_base = OTHER; note = 2'-O-methylcytidine
  modified_base 19: mod_base = OTHER; note = 2'-O-methyluridine
  modified_base 20: mod_base = OTHER; note = 2'-O-methyluridine
  modified_base 21: mod_base = OTHER; note = 2'-O-methylcytidine
  modified_base 22: mod_base = OTHER; note = 2'-fluorocytidine
  modified_base 23: mod_base = OTHER; note = 2'-fluoroadenosine
  modified_base 24: mod_base = OTHER; note = 2'-fluorouridine
  modified_base 25: mod_base = OTHER; note = 2'-O-methylguanosine
  modified_base 26: mod_base = OTHER; note = 2'-O-methyladenosine
  modified_base 27: mod_base = OTHER; note = 2'-O-methyladenosine
  modified_base 28: mod_base = OTHER; note = 2'-O-methylcytidine
  modified_base 29: mod_base = OTHER; note = 2'-O-methyladenosine
  modified_base 30: mod_base = OTHER; note = 2'-O-methyluridine
  modified_base 31: mod_base = OTHER; note = 2'-O-methylcytidine
  modified_base 32: mod_base = OTHER; note = 2'-O-methyluridine
  modified_base 33: mod_base = OTHER; note = 2'-O-methyladenosine
  modified_base 34: mod_base = OTHER; note = 2'-O-methyladenosine

SEQ ID NO: 969 - RNA, 34 nt, synthetic construct; identical to SEQ ID NO: 717
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyluridine
  modified_base 4: mod_base = OTHER; note = 2'-O-methyladenosine
  modified_base 5: mod_base = OTHER; note = 2'-O-methylguanosine
  modified_base 6: mod_base = OTHER; note = 2'-O-methylcytidine
  modified_base 7: mod_base = OTHER; note = 2'-O-methyladenosine
  modified_base 8: mod_base = OTHER; note = 2'-O-methylguanosine
  modified_base 9: mod_base = OTHER; note = 2'-O-methyluridine
  modified_base 10: mod_base = OTHER; note = 2'-O-methylguanosine
  modified_base 11: mod_base = OTHER; note = 2'-O-methylguanosine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methylguanosine
  modified_base 16: mod_base = OTHER; note = 2'-O-methyladenosine
  modified_base 17: mod_base = OTHER; note = 2'-O-methylguanosine
  modified_base 18: mod_base = OTHER; note = 2'-O-methyladenosine
  modified_base 19: mod_base = OTHER; note = 2'-O-methyluridine
  modified_base 20: mod_base = OTHER; note = 2'-O-methylcytidine
  modified_base 21: mod_base = OTHER; note = 2'-O-methyluridine
  modified_base 22: mod_base = OTHER; note = 2'-fluorouridine
  modified_base 23: mod_base = OTHER; note = 2'-fluorouridine
  modified_base 24: mod_base = OTHER; note = 2'-fluorocytidine
  modified_base 25: mod_base = OTHER; note = 2'-O-methylcytidine
  modified_base 26: mod_base = OTHER; note = 2'-O-methyladenosine
  modified_base 27: mod_base = OTHER; note = 2'-O-methylcytidine
  modified_base 28: mod_base = OTHER; note = 2'-O-methyluridine
  modified_base 29: mod_base = OTHER; note = 2'-O-methylguanosine
  modified_base 30: mod_base = OTHER; note = 2'-O-methylcytidine
  modified_base 31: mod_base = OTHER; note = 2'-O-methyluridine
  modified_base 32: mod_base = OTHER; note = 2'-O-methyladenosine
  modified_base 33: mod_base = OTHER; note = 2'-O-methyluridine
  modified_base 34: mod_base = OTHER; note = 2'-O-methyladenosine

SEQ ID NO: 970 - RNA, 34 nt, synthetic construct; identical to SEQ ID NO: 718
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methyluridine
  modified_base 5: mod_base = OTHER; note = 2'-O-methyluridine
  modified_base 6: mod_base = OTHER; note = 2'-O-methylcytidine
  modified_base 7: mod_base = OTHER; note = 2'-O-methyladenosine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methyluridine
  modified_base 11: mod_base = OTHER; note = 2'-O-methylguanosine
  modified_base 12: mod_base = OTHER; note = 2'-O-methylguanosine
  modified_base 13: mod_base = OTHER; note = 2'-O-methylcytidine
  modified_base 14: mod_base = OTHER; note = 2'-fluoroadenosine
  modified_base 15: mod_base = OTHER; note = 2'-O-methylguanosine
  modified_base 16: mod_base = OTHER; note = 2'-O-methylguanosine
  modified_base 17: mod_base = OTHER; note = 2'-O-methyluridine
  modified_base 18: mod_base = OTHER; note = 2'-O-methylguanosine
  modified_base 19: mod_base = OTHER; note = 2'-O-methylcytidine
  modified_base 20: mod_base = OTHER; note = 2'-O-methylcytidine
  modified_base 21: mod_base = OTHER; note = 2'-O-methyluridine
  modified_base 22: mod_base = OTHER; note = 2'-fluoroguanosine
  modified_base 23: mod_base = OTHER; note = 2'-fluorocytidine
  modified_base 24: mod_base = OTHER; note = 2'-fluorocytidine
  modified_base 25: mod_base = OTHER; note = 2'-O-methyladenosine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methyluridine
  modified_base 29: mod_base = OTHER; note = 2'-O-methylguanosine
  modified_base 30: mod_base = OTHER; note = 2'-O-methyladenosine
  modified_base 31: mod_base = OTHER; note = 2'-O-methyladenosine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 971 - RNA, 34 nt, synthetic construct; identical to SEQ ID NO: 719
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyluridine
  modified_base 4: mod_base = OTHER; note = 2'-O-methyluridine
  modified_base 5: mod_base = OTHER; note = 2'-O-methylguanosine
  modified_base 6: mod_base = OTHER; note = 2'-O-methyladenosine
  modified_base 7: mod_base = OTHER; note = 2'-O-methyluridine
  modified_base 8: mod_base = OTHER; note = 2'-O-methylguanosine
  modified_base 9: mod_base = OTHER; note = 2'-O-methyluridine
  modified_base 10: mod_base = OTHER; note = 2'-O-methyluridine
  modified_base 11: mod_base = OTHER; note = 2'-O-methylcytidine
  modified_base 12: mod_base = OTHER; note = 2'-O-methyladenosine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methyluridine
  modified_base 16: mod_base = OTHER; note = 2'-O-methylguanosine
  modified_base 17: mod_base = OTHER; note = 2'-O-methylguanosine
  modified_base 18: mod_base = OTHER; note = 2'-O-methyluridine
  modified_base 19: mod_base = OTHER; note = 2'-O-methyluridine
  modified_base 20: mod_base = OTHER; note = 2'-O-methyladenosine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluorouridine
  modified_base 24: mod_base = OTHER; note = 2'-fluoroguanosine
  modified_base 25: mod_base = OTHER; note = 2'-O-methyladenosine
  modified_base 26: mod_base = OTHER; note = 2'-O-methyladenosine
  modified_base 27: mod_base = OTHER; note = 2'-O-methylcytidine
  modified_base 28: mod_base = OTHER; note = 2'-O-methyladenosine
  modified_base 29: mod_base = OTHER; note = 2'-O-methyluridine
  modified_base 30: mod_base = OTHER; note = 2'-O-methylcytidine
  modified_base 31: mod_base = OTHER; note = 2'-O-methyladenosine
  modified_base 32: mod_base = OTHER; note = 2'-O-methyladenosine
  modified_base 33: mod_base = OTHER; note = 2'-O-methyluridine
  modified_base 34: mod_base = OTHER; note = 2'-O-methyladenosine

SEQ ID NO: 972 - RNA, 34 nt, synthetic construct; identical to SEQ ID NO: 720
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methylguanosine
  modified_base 5: mod_base = OTHER; note = 2'-O-methylcytidine
  modified_base 6: mod_base = OTHER; note = 2'-O-methylcytidine
  modified_base 7: mod_base = OTHER; note = 2'-O-methyladenosine
  modified_base 8: mod_base = OTHER; note = 2'-O-methylguanosine
  modified_base 9: mod_base = OTHER; note = 2'-O-methylguanosine
  modified_base 10: mod_base = OTHER; note = 2'-O-methylguanosine
  modified_base 11: mod_base = OTHER; note = 2'-O-methylcytidine
  modified_base 12: mod_base = OTHER; note = 2'-O-methyladenosine
  modified_base 13: mod_base = OTHER; note = 2'-O-methylguanosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-O-methylcytidine
  modified_base 17: mod_base = OTHER; note = 2'-O-methyluridine
  modified_base 18: mod_base = OTHER; note = 2'-O-methyluridine
  modified_base 19: mod_base = OTHER; note = 2'-O-methylguanosine
  modified_base 20: mod_base = OTHER; note = 2'-O-methyluridine
  modified_base 21: mod_base = OTHER; note = 2'-O-methylguanosine
  modified_base 22: mod_base = OTHER; note = 2'-fluorocytidine
  modified_base 23: mod_base = OTHER; note = 2'-fluorouridine
  modified_base 24: mod_base = OTHER; note = 2'-fluoroguanosine
  modified_base 25: mod_base = OTHER; note = 2'-O-methylcytidine
  modified_base 26: mod_base = OTHER; note = 2'-O-methylcytidine
  modified_base 27: mod_base = OTHER; note = 2'-O-methylcytidine
  modified_base 28: mod_base = OTHER; note = 2'-O-methyluridine
  modified_base 29: mod_base = OTHER; note = 2'-O-methylguanosine
  modified_base 30: mod_base = OTHER; note = 2'-O-methylguanosine
  modified_base 31: mod_base = OTHER; note = 2'-O-methylcytidine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 973 - RNA, 34 nt, synthetic construct; identical to SEQ ID NO: 721
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyluridine
  modified_base 4: mod_base = OTHER; note = 2'-O-methylcytidine
  modified_base 5: mod_base = OTHER; note = 2'-O-methyladenosine
  modified_base 6: mod_base = OTHER; note = 2'-O-methylguanosine
  modified_base 7: mod_base = OTHER; note = 2'-O-methyluridine
  modified_base 8: mod_base = OTHER; note = 2'-O-methylguanosine
  modified_base 9: mod_base = OTHER; note = 2'-O-methyluridine
  modified_base 10: mod_base = OTHER; note = 2'-O-methylcytidine
  modified_base 11: mod_base = OTHER; note = 2'-O-methylcytidine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-fluoroguanosine
  modified_base 15: mod_base = OTHER; note = 2'-O-methylcytidine
  modified_base 16: mod_base = OTHER; note = 2'-O-methyluridine
  modified_base 17: mod_base = OTHER; note = 2'-O-methylguanosine
  modified_base 18: mod_base = OTHER; note = 2'-O-methyladenosine
  modified_base 19: mod_base = OTHER; note = 2'-O-methyladenosine
  modified_base 20: mod_base = OTHER; note = 2'-O-methylguanosine
  modified_base 21: mod_base = OTHER; note = 2'-O-methylcytidine
  modified_base 22: mod_base = OTHER; note = 2'-fluorouridine
  modified_base 23: mod_base = OTHER; note = 2'-fluorouridine
  modified_base 24: mod_base = OTHER; note = 2'-fluoroguanosine
  modified_base 25: mod_base = OTHER; note = 2'-O-methylguanosine
  modified_base 26: mod_base = OTHER; note = 2'-O-methyladenosine
  modified_base 27: mod_base = OTHER; note = 2'-O-methylcytidine
  modified_base 28: mod_base = OTHER; note = 2'-O-methyladenosine
  modified_base 29: mod_base = OTHER; note = 2'-O-methylcytidine
  modified_base 30: mod_base = OTHER; note = 2'-O-methyluridine
  modified_base 31: mod_base = OTHER; note = 2'-O-methylguanosine
  modified_base 32: mod_base = OTHER; note = 2'-O-methyladenosine
  modified_base 33: mod_base = OTHER; note = 2'-O-methylguanosine
  modified_base 34: mod_base = OTHER; note = 2'-O-methyladenosine

SEQ ID NO: 974 - RNA, 34 nt, synthetic construct; identical to SEQ ID NO: 722
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methylguanosine
  modified_base 5: mod_base = OTHER; note = 2'-O-methyladenosine
  modified_base 6: mod_base = OTHER; note = 2'-O-methylguanosine
  modified_base 7: mod_base = OTHER; note = 2'-O-methyladenosine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methylguanosine
  modified_base 11: mod_base = OTHER; note = 2'-O-methylguanosine
  modified_base 12: mod_base = OTHER; note = 2'-O-methylcytidine
  modified_base 13: mod_base = OTHER; note = 2'-O-methyluridine
  modified_base 14: mod_base = OTHER; note = 2'-fluorouridine
  modified_base 15: mod_base = OTHER; note = 2'-O-methyluridine
  modified_base 16: mod_base = OTHER; note = 2'-O-methylcytidine
  modified_base 17: mod_base = OTHER; note = 2'-O-methyladenosine
  modified_base 18: mod_base = OTHER; note = 2'-O-methyluridine
  modified_base 19: mod_base = OTHER; note = 2'-O-methylcytidine
  modified_base 20: mod_base = OTHER; note = 2'-O-methyladenosine
  modified_base 21: mod_base = OTHER; note = 2'-O-methyladenosine
  modified_base 22: mod_base = OTHER; note = 2'-fluoroadenosine
  modified_base 23: mod_base = OTHER; note = 2'-fluoroguanosine
  modified_base 24: mod_base = OTHER; note = 2'-fluorocytidine
  modified_base 25: mod_base = OTHER; note = 2'-O-methylcytidine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methyluridine
  modified_base 29: mod_base = OTHER; note = 2'-O-methylcytidine
  modified_base 30: mod_base = OTHER; note = 2'-O-methyluridine
  modified_base 31: mod_base = OTHER; note = 2'-O-methylcytidine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 975 - RNA, 34 nt, synthetic construct; identical to SEQ ID NO: 723
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyluridine
  modified_base 4: mod_base = OTHER; note = 2'-O-methylcytidine
  modified_base 5: mod_base = OTHER; note = 2'-O-methylcytidine
  modified_base 6: mod_base = OTHER; note = 2'-O-methyladenosine
  modified_base 7: mod_base = OTHER; note = 2'-O-methylguanosine
  modified_base 8: mod_base = OTHER; note = 2'-O-methyladenosine
  modified_base 9: mod_base = OTHER; note = 2'-O-methyluridine
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-O-methyluridine
  modified_base 13: mod_base = OTHER; note = 2'-O-methylcytidine
  modified_base 14: mod_base = OTHER; note = 2'-fluorocytidine
  modified_base 15: mod_base = OTHER; note = 2'-O-methyluridine
  modified_base 16: mod_base = OTHER; note = 2'-O-methylcytidine
  modified_base 17: mod_base = OTHER; note = 2'-O-methylcytidine
  modified_base 18: mod_base = OTHER; note = 2'-O-methylcytidine
  modified_base 19: mod_base = OTHER; note = 2'-O-methyluridine
  modified_base 20: mod_base = OTHER; note = 2'-O-methyladenosine
  modified_base 21: mod_base = OTHER; note = 2'-O-methylguanosine
  modified_base 22: mod_base = OTHER; note = 2'-fluoroguanosine
  modified_base 23: mod_base = OTHER; note = 2'-fluoroadenosine
  modified_base 24: mod_base = OTHER; note = 2'-fluorouridine
  modified_base 25: mod_base = OTHER; note = 2'-O-methyluridine
  modified_base 26: mod_base = OTHER; note = 2'-O-methyladenosine
  modified_base 27: mod_base = OTHER; note = 2'-O-methyluridine
  modified_base 28: mod_base = OTHER; note = 2'-O-methylcytidine
  modified_base 29: mod_base = OTHER; note = 2'-O-methyluridine
  modified_base 30: mod_base = OTHER; note = 2'-O-methylguanosine
  modified_base 31: mod_base = OTHER; note = 2'-O-methylguanosine
  modified_base 32: mod_base = OTHER; note = 2'-O-methyladenosine
  modified_base 33: mod_base = OTHER; note = 2'-O-methyluridine
  modified_base 34: mod_base = OTHER; note = 2'-O-methyladenosine

SEQ ID NO: 976 - RNA, 34 nt, synthetic construct; identical to SEQ ID NO: 724
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyluridine
  modified_base 4: mod_base = OTHER; note = 2'-O-methyluridine
  modified_base 5: mod_base = OTHER; note = 2'-O-methylcytidine
  modified_base 6: mod_base = OTHER; note = 2'-O-methyluridine
  modified_base 7: mod_base = OTHER; note = 2'-O-methylcytidine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyluridine
  modified_base 11: mod_base = OTHER; note = 2'-O-methyluridine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-fluoroguanosine
  modified_base 15: mod_base = OTHER; note = 2'-O-methyluridine
  modified_base 16: mod_base = OTHER; note = 2'-O-methyluridine
  modified_base 17: mod_base = OTHER; note = 2'-O-methylguanosine
  modified_base 18: mod_base = OTHER; note = 2'-O-methyladenosine
  modified_base 19: mod_base = OTHER; note = 2'-O-methylcytidine
  modified_base 20: mod_base = OTHER; note = 2'-O-methyladenosine
  modified_base 21: mod_base = OTHER; note = 2'-O-methylcytidine
  modified_base 22: mod_base = OTHER; note = 2'-fluorouridine
  modified_base 23: mod_base = OTHER; note = 2'-fluorouridine
  modified_base 24: mod_base = OTHER; note = 2'-fluoroadenosine
  modified_base 25: mod_base = OTHER; note = 2'-O-methyladenosine
  modified_base 26: mod_base = OTHER; note = 2'-O-methyluridine
  modified_base 27: mod_base = OTHER; note = 2'-O-methyluridine
  modified_base 28: mod_base = OTHER; note = 2'-O-methylguanosine
  modified_base 29: mod_base = OTHER; note = 2'-O-methyladenosine
  modified_base 30: mod_base = OTHER; note = 2'-O-methylguanosine
  modified_base 31: mod_base = OTHER; note = 2'-O-methyladenosine
  modified_base 32: mod_base = OTHER; note = 2'-O-methyladenosine
  modified_base 33: mod_base = OTHER; note = 2'-O-methylguanosine
  modified_base 34: mod_base = OTHER; note = 2'-O-methyladenosine

SEQ ID NO: 977 - RNA, 34 nt, synthetic construct; identical to SEQ ID NO: 725
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methylcytidine
  modified_base 4: mod_base = OTHER; note = 2'-O-methyladenosine
  modified_base 5: mod_base = OTHER; note = 2'-O-methylguanosine
  modified_base 6: mod_base = OTHER; note = 2'-O-methyladenosine
  modified_base 7: mod_base = OTHER; note = 2'-O-methylcytidine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methyladenosine
  modified_base 11: mod_base = OTHER; note = 2'-O-methylguanosine
  modified_base 12: mod_base = OTHER; note = 2'-O-methyladenosine
  modified_base 13: mod_base = OTHER; note = 2'-O-methylcytidine
  modified_base 14: mod_base = OTHER; note = 2'-fluorocytidine
  modified_base 15: mod_base = OTHER; note = 2'-O-methyluridine
  modified_base 16: mod_base = OTHER; note = 2'-O-methylguanosine
  modified_base 17: mod_base = OTHER; note = 2'-O-methylguanosine
  modified_base 18: mod_base = OTHER; note = 2'-O-methyluridine
  modified_base 19: mod_base = OTHER; note = 2'-O-methylcytidine
  modified_base 20: mod_base = OTHER; note = 2'-O-methyladenosine
  modified_base 21: mod_base = OTHER; note = 2'-O-methylguanosine
  modified_base 22: mod_base = OTHER; note = 2'-fluoroguanosine
  modified_base 23: mod_base = OTHER; note = 2'-fluorouridine
  modified_base 24: mod_base = OTHER; note = 2'-fluorocytidine
  modified_base 25: mod_base = OTHER; note = 2'-O-methyluridine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methylguanosine
  modified_base 29: mod_base = OTHER; note = 2'-O-methyluridine
  modified_base 30: mod_base = OTHER; note = 2'-O-methylcytidine
  modified_base 31: mod_base = OTHER; note = 2'-O-methyluridine
  modified_base 32: mod_base = OTHER; note = 2'-O-methylguanosine
  modified_base 33: mod_base = OTHER; note = 2'-O-methylguanosine
  modified_base 34: mod_base = OTHER; note = 2'-O-methyladenosine

SEQ ID NO: 978 - RNA, 34 nt, synthetic construct; identical to SEQ ID NO: 726
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methylcytidine
  modified_base 6: mod_base = OTHER; note = 2'-O-methylguanosine
  modified_base 7: mod_base = OTHER; note = 2'-O-methyluridine
  modified_base 8: mod_base = OTHER; note = 2'-O-methylcytidine
  modified_base 9: mod_base = OTHER; note = 2'-O-methyladenosine
  modified_base 10: mod_base = OTHER; note = 2'-O-methyluridine
  modified_base 11: mod_base = OTHER; note = 2'-O-methyladenosine
  modified_base 12: mod_base = OTHER; note = 2'-O-methylguanosine
  modified_base 13: mod_base = OTHER; note = 2'-O-methyluridine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-O-methyluridine
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = OTHER; note = 2'-O-methyluridine
  modified_base 21: mod_base = OTHER; note = 2'-O-methylguanosine
  modified_base 22: mod_base = OTHER; note = 2'-fluoroadenosine
  modified_base 23: mod_base = OTHER; note = 2'-fluorocytidine
  modified_base 24: mod_base = OTHER; note = 2'-fluorouridine
  modified_base 25: mod_base = OTHER; note = 2'-O-methyladenosine
  modified_base 26: mod_base = OTHER; note = 2'-O-methyluridine
  modified_base 27: mod_base = OTHER; note = 2'-O-methylguanosine
  modified_base 28: mod_base = OTHER; note = 2'-O-methyladenosine
  modified_base 29: mod_base = OTHER; note = 2'-O-methylcytidine
  modified_base 30: mod_base = OTHER; note = 2'-O-methylguanosine
  modified_base 31: mod_base = OTHER; note = 2'-O-methyluridine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 979 - RNA, 34 nt, synthetic construct; identical to SEQ ID NO: 727
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methyluridine
  modified_base 4: mod_base = OTHER; note = 2'-O-methylguanosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyluridine
  modified_base 8: mod_base = OTHER; note = 2'-O-methylguanosine
  modified_base 9: mod_base = OTHER; note = 2'-O-methyladenosine
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-O-methylcytidine
  modified_base 13: mod_base = OTHER; note = 2'-O-methylguanosine
  modified_base 14: mod_base = OTHER; note = 2'-fluoroadenosine
  modified_base 15: mod_base = OTHER; note = 2'-O-methylcytidine
  modified_base 16: mod_base = OTHER; note = 2'-O-methyluridine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methyluridine
  modified_base 20: mod_base = OTHER; note = 2'-O-methylguanosine
  modified_base 21: mod_base = OTHER; note = 2'-O-methyluridine
  modified_base 22: mod_base = OTHER; note = 2'-fluorocytidine
  modified_base 23: mod_base = OTHER; note = 2'-fluoroguanosine
  modified_base 24: mod_base = OTHER; note = 2'-fluorouridine
  modified_base 25: mod_base = OTHER; note = 2'-O-methyluridine
  modified_base 26: mod_base = OTHER; note = 2'-O-methyluridine
  modified_base 27: mod_base = OTHER; note = 2'-O-methylcytidine
  modified_base 28: mod_base = OTHER; note = 2'-O-methyladenosine
  modified_base 29: mod_base = OTHER; note = 2'-O-methyluridine
  modified_base 30: mod_base = OTHER; note = 2'-O-methyluridine
  modified_base 31: mod_base = OTHER; note = 2'-O-methylcytidine
  modified_base 32: mod_base = OTHER; note = 2'-O-methyladenosine
  modified_base 33: mod_base = OTHER; note = 2'-O-methyladenosine
  modified_base 34: mod_base = OTHER; note = 2'-O-methyladenosine

SEQ ID NO: 980 - RNA, 34 nt, synthetic construct; identical to SEQ ID NO: 728
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methylcytidine
  modified_base 4: mod_base = OTHER; note = 2'-O-methyluridine
  modified_base 5: mod_base = OTHER; note = 2'-O-methylcytidine
  modified_base 6: mod_base = OTHER; note = 2'-O-methylcytidine
  modified_base 7: mod_base = OTHER; note = 2'-O-methyluridine
  modified_base 8: mod_base = OTHER; note = 2'-O-methylcytidine
  modified_base 9: mod_base = OTHER; note = 2'-O-methyladenosine
  modified_base 10: mod_base = OTHER; note = 2'-O-methylguanosine
  modified_base 11: mod_base = OTHER; note = 2'-O-methyladenosine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methylcytidine
  modified_base 19: mod_base = OTHER; note = 2'-O-methyladenosine
  modified_base 20: mod_base = OTHER; note = 2'-O-methyluridine
  modified_base 21: mod_base = OTHER; note = 2'-O-methylguanosine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluorouridine
  modified_base 25: mod_base = OTHER; note = 2'-O-methylcytidine
  modified_base 26: mod_base = OTHER; note = 2'-O-methyluridine
  modified_base 27: mod_base = OTHER; note = 2'-O-methylguanosine
  modified_base 28: mod_base = OTHER; note = 2'-O-methyladenosine
  modified_base 29: mod_base = OTHER; note = 2'-O-methylguanosine
  modified_base 30: mod_base = OTHER; note = 2'-O-methylguanosine
  modified_base 31: mod_base = OTHER; note = 2'-O-methyladenosine
  modified_base 32: mod_base = OTHER; note = 2'-O-methylguanosine
  modified_base 33: mod_base = OTHER; note = 2'-O-methylguanosine
  modified_base 34: mod_base = OTHER; note = 2'-O-methyladenosine

SEQ ID NO: 981 - RNA, 34 nt, synthetic construct; identical to SEQ ID NO: 729
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-O-methylguanosine
  modified_base 5: mod_base = OTHER; note = 2'-O-methylcytidine
  modified_base 6: mod_base = OTHER; note = 2'-O-methylcytidine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methylguanosine
  modified_base 11: mod_base = OTHER; note = 2'-O-methylcytidine
  modified_base 12: mod_base = OTHER; note = 2'-O-methyladenosine
  modified_base 13: mod_base = OTHER; note = 2'-O-methyluridine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methyladenosine
  modified_base 17: mod_base = OTHER; note = 2'-O-methyluridine
  modified_base 18: mod_base = OTHER; note = 2'-O-methylguanosine
  modified_base 19: mod_base = OTHER; note = 2'-O-methyluridine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluoroadenosine
  modified_base 23: mod_base = OTHER; note = 2'-fluorouridine
  modified_base 24: mod_base = OTHER; note = 2'-fluoroguanosine
  modified_base 25: mod_base = OTHER; note = 2'-O-methylcytidine
  modified_base 26: mod_base = OTHER; note = 2'-O-methyluridine
  modified_base 27: mod_base = OTHER; note = 2'-O-methyluridine
  modified_base 28: mod_base = OTHER; note = 2'-O-methyluridine
  modified_base 29: mod_base = OTHER; note = 2'-O-methylguanosine
  modified_base 30: mod_base = OTHER; note = 2'-O-methylguanosine
  modified_base 31: mod_base = OTHER; note = 2'-O-methylcytidine
  modified_base 32: mod_base = OTHER; note = 2'-O-methyluridine
  modified_base 33: mod_base = OTHER; note = 2'-O-methyluridine
  modified_base 34: mod_base = OTHER; note = 2'-O-methyladenosine

SEQ ID NO: 982 - RNA, 34 nt, synthetic construct; identical to SEQ ID NO: 730
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylguanosine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methylcytidine
  modified_base 8: mod_base = OTHER; note = 2'-O-methylguanosine
  modified_base 9: mod_base = OTHER; note = 2'-O-methyladenosine
  modified_base 10: mod_base = OTHER; note = 2'-O-methylcytidine
  modified_base 11: mod_base = OTHER; note = 2'-O-methyluridine
  modified_base 12: mod_base = OTHER; note = 2'-O-methyluridine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methylcytidine
  modified_base 16: mod_base = OTHER; note = 2'-O-methyluridine
  modified_base 17: mod_base = OTHER; note = 2'-O-methyluridine
  modified_base 18: mod_base = OTHER; note = 2'-O-methylguanosine
  modified_base 19: mod_base = OTHER; note = 2'-O-methyluridine
  modified_base 20: mod_base = OTHER; note = 2'-O-methylguanosine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluoroadenosine
  modified_base 24: mod_base = OTHER; note = 2'-fluoroadenosine
  modified_base 25: mod_base = OTHER; note = 2'-O-methylguanosine
  modified_base 26: mod_base = OTHER; note = 2'-O-methyluridine
  modified_base 27: mod_base = OTHER; note = 2'-O-methylcytidine
  modified_base 28: mod_base = OTHER; note = 2'-O-methylguanosine
  modified_base 29: mod_base = OTHER; note = 2'-O-methyluridine
  modified_base 30: mod_base = OTHER; note = 2'-O-methyluridine
  modified_base 31: mod_base = OTHER; note = 2'-O-methyluridine
  modified_base 32: mod_base = OTHER; note = 2'-O-methylcytidine
  modified_base 33: mod_base = OTHER; note = 2'-O-methyladenosine
  modified_base 34: mod_base = OTHER; note = 2'-O-methyladenosine

SEQ ID NO: 983 - RNA, 34 nt, synthetic construct; identical to SEQ ID NO: 731
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-O-methylcytidine
  modified_base 5: mod_base = OTHER; note = 2'-O-methyluridine
  modified_base 6: mod_base = OTHER; note = 2'-O-methyluridine
  modified_base 7: mod_base = OTHER; note = 2'-O-methylguanosine
  modified_base 8: mod_base = OTHER; note = 2'-O-methyluridine
  modified_base 9: mod_base = OTHER; note = 2'-O-methylguanosine
  modified_base 10: mod_base = OTHER; note = 2'-O-methylguanosine
  modified_base 11: mod_base = OTHER; note = 2'-O-methyluridine
  modified_base 12: mod_base = OTHER; note = 2'-O-methylcytidine
  modified_base 13: mod_base = OTHER; note = 2'-O-methyluridine
  modified_base 14: mod_base = OTHER; note = 2'-fluorouridine
  modified_base 15: mod_base = OTHER; note = 2'-O-methylcytidine
  modified_base 16: mod_base = OTHER; note = 2'-O-methyladenosine
  modified_base 17: mod_base = OTHER; note = 2'-O-methyluridine
  modified_base 18: mod_base = OTHER; note = 2'-O-methyladenosine
  modified_base 19: mod_base = OTHER; note = 2'-O-methyladenosine
  modified_base 20: mod_base = OTHER; note = 2'-O-methylguanosine
  modified_base 21: mod_base = OTHER; note = 2'-O-methyladenosine
  modified_base 22: mod_base = OTHER; note = 2'-fluoroadenosine
  modified_base 23: mod_base = OTHER; note = 2'-fluoroguanosine
  modified_base 24: mod_base = OTHER; note = 2'-fluoroadenosine
  modified_base 25: mod_base = OTHER; note = 2'-O-methylcytidine
  modified_base 26: mod_base = OTHER; note = 2'-O-methylcytidine
  modified_base 27: mod_base = OTHER; note = 2'-O-methyladenosine
  modified_base 28: mod_base = OTHER; note = 2'-O-methylcytidine
  modified_base 29: mod_base = OTHER; note = 2'-O-methyladenosine
  modified_base 30: mod_base = OTHER; note = 2'-O-methyladenosine
  modified_base 31: mod_base = OTHER; note = 2'-O-methylguanosine
  modified_base 32: mod_base = OTHER; note = 2'-O-methyluridine
  modified_base 33: mod_base = OTHER; note = 2'-O-methyluridine
  modified_base 34: mod_base = OTHER; note = 2'-O-methyladenosine

SEQ ID NO: 984 - RNA, 34 nt, synthetic construct; identical to SEQ ID NO: 732
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methylcytidine
  modified_base 4: mod_base = OTHER; note = 2'-O-methyladenosine
  modified_base 5: mod_base = OTHER; note = 2'-O-methylguanosine
  modified_base 6: mod_base = OTHER; note = 2'-O-methylguanosine
  modified_base 7: mod_base = OTHER; note = 2'-O-methyluridine
  modified_base 8: mod_base = OTHER; note = 2'-O-methyladenosine
  modified_base 9: mod_base = OTHER; note = 2'-O-methylguanosine
  modified_base 10: mod_base = OTHER; note = 2'-O-methyladenosine
  modified_base 11: mod_base = OTHER; note = 2'-O-methyluridine
  modified_base 12: mod_base = OTHER; note = 2'-O-methylguanosine
  modified_base 13: mod_base = OTHER; note = 2'-O-methyluridine
  modified_base 14: mod_base = OTHER; note = 2'-fluorouridine
  modified_base 15: mod_base = OTHER; note = 2'-O-methylcytidine
  modified_base 16: mod_base = OTHER; note = 2'-O-methyladenosine
  modified_base 17: mod_base = OTHER; note = 2'-O-methyluridine
  modified_base 18: mod_base = OTHER; note = 2'-O-methylguanosine
  modified_base 19: mod_base = OTHER; note = 2'-O-methylguanosine
  modified_base 20: mod_base = OTHER; note = 2'-O-methylguanosine
  modified_base 21: mod_base = OTHER; note = 2'-O-methyladenosine
  modified_base 22: mod_base = OTHER; note = 2'-fluoroadenosine
  modified_base 23: mod_base = OTHER; note = 2'-fluorocytidine
  modified_base 24: mod_base = OTHER; note = 2'-fluoroadenosine
  modified_base 25: mod_base = OTHER; note = 2'-O-methyluridine
  modified_base 26: mod_base = OTHER; note = 2'-O-methylcytidine
  modified_base 27: mod_base = OTHER; note = 2'-O-methyluridine
  modified_base 28: mod_base = OTHER; note = 2'-O-methyladenosine
  modified_base 29: mod_base = OTHER; note = 2'-O-methylcytidine
  modified_base 30: mod_base = OTHER; note = 2'-O-methylcytidine
  modified_base 31: mod_base = OTHER; note = 2'-O-methyluridine
  modified_base 32: mod_base = OTHER; note = 2'-O-methylguanosine
  modified_base 33: mod_base = OTHER; note = 2'-O-methylguanosine
  modified_base 34: mod_base = OTHER; note = 2'-O-methyladenosine

SEQ ID NO: 985 - RNA, 34 nt, synthetic construct; identical to SEQ ID NO: 733
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyluridine
  modified_base 4: mod_base = OTHER; note = 2'-O-methylguanosine
  modified_base 5: mod_base = OTHER; note = 2'-O-methyluridine
  modified_base 6: mod_base = OTHER; note = 2'-O-methylguanosine
  modified_base 7: mod_base = OTHER; note = 2'-O-methyluridine
  modified_base 8: mod_base = OTHER; note = 2'-O-methyluridine
  modified_base 9: mod_base = OTHER; note = 2'-O-methylcytidine
  modified_base 10: mod_base = OTHER; note = 2'-O-methyluridine
  modified_base 11: mod_base = OTHER; note = 2'-O-methylguanosine
  modified_base 12: mod_base = OTHER; note = 2'-O-methylguanosine
  modified_base 13: mod_base = OTHER; note = 2'-O-methylcytidine
  modified_base 14: mod_base = OTHER; note = 2'-fluoroadenosine
  modified_base 15: mod_base = OTHER; note = 2'-O-methylcytidine
  modified_base 16: mod_base = OTHER; note = 2'-O-methylcytidine
  modified_base 17: mod_base = OTHER; note = 2'-O-methyluridine
  modified_base 18: mod_base = OTHER; note = 2'-O-methylguanosine
  modified_base 19: mod_base = OTHER; note = 2'-O-methylcytidine
  modified_base 20: mod_base = OTHER; note = 2'-O-methylguanosine
  modified_base 21: mod_base = OTHER; note = 2'-O-methyluridine
  modified_base 22: mod_base = OTHER; note = 2'-fluoroguanosine
  modified_base 23: mod_base = OTHER; note = 2'-fluorocytidine
  modified_base 24: mod_base = OTHER; note = 2'-fluorocytidine
  modified_base 25: mod_base = OTHER; note = 2'-O-methyladenosine
  modified_base 26: mod_base = OTHER; note = 2'-O-methylguanosine
  modified_base 27: mod_base = OTHER; note = 2'-O-methyladenosine
  modified_base 28: mod_base = OTHER; note = 2'-O-methyladenosine
  modified_base 29: mod_base = OTHER; note = 2'-O-methylcytidine
  modified_base 30: mod_base = OTHER; note = 2'-O-methyladenosine
  modified_base 31: mod_base = OTHER; note = 2'-O-methylcytidine
  modified_base 32: mod_base = OTHER; note = 2'-O-methyladenosine
  modified_base 33: mod_base = OTHER; note = 2'-O-methylguanosine
  modified_base 34: mod_base = OTHER; note = 2'-O-methyladenosine

SEQ ID NO: 986 - RNA, 34 nt, synthetic construct; identical to SEQ ID NO: 734
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-O-methylcytidine
  modified_base 5: mod_base = OTHER; note = 2'-O-methyluridine
  modified_base 6: mod_base = OTHER; note = 2'-O-methyluridine
  modified_base 7: mod_base = OTHER; note = 2'-O-methylguanosine
  modified_base 8: mod_base = OTHER; note = 2'-O-methylcytidine
  modified_base 9: mod_base = OTHER; note = 2'-O-methylcytidine
  modified_base 10: mod_base = OTHER; note = 2'-O-methyladenosine
  modified_base 11: mod_base = OTHER; note = 2'-O-methylcytidine
  modified_base 12: mod_base = OTHER; note = 2'-O-methylcytidine
  modified_base 13: mod_base = OTHER; note = 2'-O-methyluridine
  modified_base 14: mod_base = OTHER; note = 2'-fluorouridine
  modified_base 15: mod_base = OTHER; note = 2'-O-methylcytidine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methyladenosine
  modified_base 20: mod_base = OTHER; note = 2'-O-methylguanosine
  modified_base 21: mod_base = OTHER; note = 2'-O-methyladenosine
  modified_base 22: mod_base = OTHER; note = 2'-fluoroadenosine
  modified_base 23: mod_base = OTHER; note = 2'-fluoroguanosine
  modified_base 24: mod_base = OTHER; note = 2'-fluoroguanosine
  modified_base 25: mod_base = OTHER; note = 2'-O-methyluridine
  modified_base 26: mod_base = OTHER; note = 2'-O-methylguanosine
  modified_base 27: mod_base = OTHER; note = 2'-O-methylguanosine
  modified_base 28: mod_base = OTHER; note = 2'-O-methylcytidine
  modified_base 29: mod_base = OTHER; note = 2'-O-methyladenosine
  modified_base 30: mod_base = OTHER; note = 2'-O-methyladenosine
  modified_base 31: mod_base = OTHER; note = 2'-O-methylguanosine
  modified_base 32: mod_base = OTHER; note = 2'-O-methyluridine
  modified_base 33: mod_base = OTHER; note = 2'-O-methyluridine
  modified_base 34: mod_base = OTHER; note = 2'-O-methyladenosine

SEQ ID NO: 987 - RNA, 34 nt, synthetic construct; identical to SEQ ID NO: 735
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methylcytidine
  modified_base 4: mod_base = OTHER; note = 2'-O-methylcytidine
  modified_base 5: mod_base = OTHER; note = 2'-O-methyladenosine
  modified_base 6: mod_base = OTHER; note = 2'-O-methyluridine
  modified_base 7: mod_base = OTHER; note = 2'-O-methylguanosine
  modified_base 8: mod_base = OTHER; note = 2'-O-methylguanosine
  modified_base 9: mod_base = OTHER; note = 2'-O-methyluridine
  modified_base 10: mod_base = OTHER; note = 2'-O-methyluridine
  modified_base 11: mod_base = OTHER; note = 2'-O-methylguanosine
  modified_base 12: mod_base = OTHER; note = 2'-O-methylcytidine
  modified_base 13: mod_base = OTHER; note = 2'-O-methyluridine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methyluridine
  modified_base 17: mod_base = OTHER; note = 2'-O-methylguanosine
  modified_base 18: mod_base = OTHER; note = 2'-O-methylguanosine
  modified_base 19: mod_base = OTHER; note = 2'-O-methyluridine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluoroadenosine
  modified_base 23: mod_base = OTHER; note = 2'-fluoroguanosine
  modified_base 24: mod_base = OTHER; note = 2'-fluorocytidine
  modified_base 25: mod_base = OTHER; note = 2'-O-methyladenosine
  modified_base 26: mod_base = OTHER; note = 2'-O-methyladenosine
  modified_base 27: mod_base = OTHER; note = 2'-O-methylcytidine
  modified_base 28: mod_base = OTHER; note = 2'-O-methylcytidine
  modified_base 29: mod_base = OTHER; note = 2'-O-methyladenosine
  modified_base 30: mod_base = OTHER; note = 2'-O-methyluridine
  modified_base 31: mod_base = OTHER; note = 2'-O-methylguanosine
  modified_base 32: mod_base = OTHER; note = 2'-O-methylguanosine
  modified_base 33: mod_base = OTHER; note = 2'-O-methylcytidine
  modified_base 34: mod_base = OTHER; note = 2'-O-methyladenosine

SEQ ID NO: 988 - RNA, 34 nt, synthetic construct; identical to SEQ ID NO: 736
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-O-methylcytidine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyluridine
  modified_base 9: mod_base = OTHER; note = 2'-O-methylguanosine
  modified_base 10: mod_base = OTHER; note = 2'-O-methylguanosine
  modified_base 11: mod_base = OTHER; note = 2'-O-methylguanosine
  modified_base 12: mod_base = OTHER; note = 2'-O-methylcytidine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methyladenosine
  modified_base 17: mod_base = OTHER; note = 2'-O-methyluridine
  modified_base 18: mod_base = OTHER; note = 2'-O-methyladenosine
  modified_base 19: mod_base = OTHER; note = 2'-O-methylguanosine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluoroguanosine
  modified_base 24: mod_base = OTHER; note = 2'-fluorocytidine
  modified_base 25: mod_base = OTHER; note = 2'-O-methylcytidine
  modified_base 26: mod_base = OTHER; note = 2'-O-methylcytidine
  modified_base 27: mod_base = OTHER; note = 2'-O-methyladenosine
  modified_base 28: mod_base = OTHER; note = 2'-O-methyluridine
  modified_base 29: mod_base = OTHER; note = 2'-O-methyluridine
  modified_base 30: mod_base = OTHER; note = 2'-O-methyluridine
  modified_base 31: mod_base = OTHER; note = 2'-O-methylguanosine
  modified_base 32: mod_base = OTHER; note = 2'-O-methyluridine
  modified_base 33: mod_base = OTHER; note = 2'-O-methylcytidine
  modified_base 34: mod_base = OTHER; note = 2'-O-methyladenosine

SEQ ID NO: 989 - RNA, 34 nt, synthetic construct; identical to SEQ ID NO: 737
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-O-methylguanosine
  modified_base 5: mod_base = OTHER; note = 2'-O-methyluridine
  modified_base 6: mod_base = OTHER; note = 2'-O-methyluridine
  modified_base 7: mod_base = OTHER; note = 2'-O-methylguanosine
  modified_base 8: mod_base = OTHER; note = 2'-O-methyladenosine
  modified_base 9: mod_base = OTHER; note = 2'-O-methylcytidine
  modified_base 10: mod_base = OTHER; note = 2'-O-methyluridine
  modified_base 11: mod_base = OTHER; note = 2'-O-methyladenosine
  modified_base 12: mod_base = OTHER; note = 2'-O-methylguanosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-O-methylcytidine
  modified_base 17: mod_base = OTHER; note = 2'-O-methyluridine
  modified_base 18: mod_base = OTHER; note = 2'-O-methyluridine
  modified_base 19: mod_base = OTHER; note = 2'-O-methyluridine
  modified_base 20: mod_base = OTHER; note = 2'-O-methyluridine
  modified_base 21: mod_base = OTHER; note = 2'-O-methylguanosine
  modified_base 22: mod_base = OTHER; note = 2'-fluorouridine
  modified_base 23: mod_base = OTHER; note = 2'-fluorocytidine
  modified_base 24: mod_base = OTHER; note = 2'-fluorouridine
  modified_base 25: mod_base = OTHER; note = 2'-O-methyladenosine
  modified_base 26: mod_base = OTHER; note = 2'-O-methylguanosine
  modified_base 27: mod_base = OTHER; note = 2'-O-methyluridine
  modified_base 28: mod_base = OTHER; note = 2'-O-methylcytidine
  modified_base 29: mod_base = OTHER; note = 2'-O-methyladenosine
  modified_base 30: mod_base = OTHER; note = 2'-O-methyladenosine
  modified_base 31: mod_base = OTHER; note = 2'-O-methylcytidine
  modified_base 32: mod_base = OTHER; note = 2'-O-methyluridine
  modified_base 33: mod_base = OTHER; note = 2'-O-methyluridine
  modified_base 34: mod_base = OTHER; note = 2'-O-methyladenosine

SEQ ID NO: 990 - RNA, 34 nt, synthetic construct; identical to SEQ ID NO: 738
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methyluridine
  modified_base 5: mod_base = OTHER; note = 2'-O-methylguanosine
  modified_base 6: mod_base = OTHER; note = 2'-O-methylguanosine
  modified_base 7: mod_base = OTHER; note = 2'-O-methylcytidine
  modified_base 8: mod_base = OTHER; note = 2'-O-methylguanosine
  modified_base 9: mod_base = OTHER; note = 2'-O-methylguanosine
  modified_base 10: mod_base = OTHER; note = 2'-O-methylguanosine
  modified_base 11: mod_base = OTHER; note = 2'-O-methyluridine
  modified_base 12: mod_base = OTHER; note = 2'-O-methylguanosine
  modified_base 13: mod_base = OTHER; note = 2'-O-methylcytidine
  modified_base 14: mod_base = OTHER; note = 2'-fluoroguanosine
  modified_base 15: mod_base = OTHER; note = 2'-O-methylguanosine
  modified_base 16: mod_base = OTHER; note = 2'-O-methyluridine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methylcytidine
  modified_base 20: mod_base = OTHER; note = 2'-O-methylcytidine
  modified_base 21: mod_base = OTHER; note = 2'-O-methylcytidine
  modified_base 22: mod_base = OTHER; note = 2'-fluoroguanosine
  modified_base 23: mod_base = OTHER; note = 2'-fluorocytidine
  modified_base 24: mod_base = OTHER; note = 2'-fluoroadenosine
  modified_base 25: mod_base = OTHER; note = 2'-O-methylcytidine
  modified_base 26: mod_base = OTHER; note = 2'-O-methylcytidine
  modified_base 27: mod_base = OTHER; note = 2'-O-methylcytidine
  modified_base 28: mod_base = OTHER; note = 2'-O-methylguanosine
  modified_base 29: mod_base = OTHER; note = 2'-O-methylcytidine
  modified_base 30: mod_base = OTHER; note = 2'-O-methylcytidine
  modified_base 31: mod_base = OTHER; note = 2'-O-methyladenosine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 991 - RNA, 34 nt, synthetic construct; identical to SEQ ID NO: 739
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methylcytidine
  modified_base 4: mod_base = OTHER; note = 2'-O-methylguanosine
  modified_base 5: mod_base = OTHER; note = 2'-O-methylguanosine
  modified_base 6: mod_base = OTHER; note = 2'-O-methyladenosine
  modified_base 7: mod_base = OTHER; note = 2'-O-methyluridine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methylcytidine
  modified_base 11: mod_base = OTHER; note = 2'-O-methyladenosine
  modified_base 12: mod_base = OTHER; note = 2'-O-methyluridine
  modified_base 13: mod_base = OTHER; note = 2'-O-methylcytidine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-O-methyluridine
  modified_base 17: mod_base = OTHER; note = 2'-O-methylguanosine
  modified_base 18: mod_base = OTHER; note = 2'-O-methyladenosine
  modified_base 19: mod_base = OTHER; note = 2'-O-methylcytidine
  modified_base 20: mod_base = OTHER; note = 2'-O-methyluridine
  modified_base 21: mod_base = OTHER; note = 2'-O-methyluridine
  modified_base 22: mod_base = OTHER; note = 2'-fluoroguanosine
  modified_base 23: mod_base = OTHER; note = 2'-fluoroadenosine
  modified_base 24: mod_base = OTHER; note = 2'-fluorouridine
  modified_base 25: mod_base = OTHER; note = 2'-O-methylguanosine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methyladenosine
  modified_base 29: mod_base = OTHER; note = 2'-O-methyluridine
  modified_base 30: mod_base = OTHER; note = 2'-O-methylcytidine
  modified_base 31: mod_base = OTHER; note = 2'-O-methylcytidine
  modified_base 32: mod_base = OTHER; note = 2'-O-methylguanosine
  modified_base 33: mod_base = OTHER; note = 2'-O-methylguanosine
  modified_base 34: mod_base = OTHER; note = 2'-O-methyladenosine

SEQ ID NO: 992 - RNA, 34 nt, synthetic construct; identical to SEQ ID NO: 740
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-O-methylguanosine
  modified_base 5: mod_base = OTHER; note = 2'-O-methylguanosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methylguanosine
  modified_base 9: mod_base = OTHER; note = 2'-O-methylcytidine
  modified_base 10: mod_base = OTHER; note = 2'-O-methylcytidine
  modified_base 11: mod_base = OTHER; note = 2'-O-methyluridine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-O-methylguanosine
  modified_base 17: mod_base = OTHER; note = 2'-O-methylcytidine
  modified_base 18: mod_base = OTHER; note = 2'-O-methyluridine
  modified_base 19: mod_base = OTHER; note = 2'-O-methylcytidine
  modified_base 20: mod_base = OTHER; note = 2'-O-methyluridine
  modified_base 21: mod_base = OTHER; note = 2'-O-methyluridine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluoroadenosine
  modified_base 25: mod_base = OTHER; note = 2'-O-methylguanosine
  modified_base 26: mod_base = OTHER; note = 2'-O-methylguanosine
  modified_base 27: mod_base = OTHER; note = 2'-O-methylcytidine
  modified_base 28: mod_base = OTHER; note = 2'-O-methyluridine
  modified_base 29: mod_base = OTHER; note = 2'-O-methyluridine
  modified_base 30: mod_base = OTHER; note = 2'-O-methylcytidine
  modified_base 31: mod_base = OTHER; note = 2'-O-methylcytidine
  modified_base 32: mod_base = OTHER; note = 2'-O-methyluridine
  modified_base 33: mod_base = OTHER; note = 2'-O-methylcytidine
  modified_base 34: mod_base = OTHER; note = 2'-O-methyladenosine

SEQ ID NO: 993 - RNA, 34 nt, synthetic construct; identical to SEQ ID NO: 741
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylcytidine
  modified_base 4: mod_base = OTHER; note = 2'-O-methyluridine
  modified_base 5: mod_base = OTHER; note = 2'-O-methyluridine
  modified_base 6: mod_base = OTHER; note = 2'-O-methyluridine
  modified_base 7: mod_base = OTHER; note = 2'-O-methylguanosine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methylcytidine
  modified_base 11: mod_base = OTHER; note = 2'-O-methyladenosine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methyluridine
  modified_base 17: mod_base = OTHER; note = 2'-O-methyluridine
  modified_base 18: mod_base = OTHER; note = 2'-O-methylguanosine
  modified_base 19: mod_base = OTHER; note = 2'-O-methylcytidine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluorouridine
  modified_base 25: mod_base = OTHER; note = 2'-O-methylguanosine
  modified_base 26: mod_base = OTHER; note = 2'-O-methyluridine
  modified_base 27: mod_base = OTHER; note = 2'-O-methyluridine
  modified_base 28: mod_base = OTHER; note = 2'-O-methylcytidine
  modified_base 29: mod_base = OTHER; note = 2'-O-methyladenosine
  modified_base 30: mod_base = OTHER; note = 2'-O-methyladenosine
  modified_base 31: mod_base = OTHER; note = 2'-O-methyladenosine
  modified_base 32: mod_base = OTHER; note = 2'-O-methylguanosine
  modified_base 33: mod_base = OTHER; note = 2'-O-methyluridine
  modified_base 34: mod_base = OTHER; note = 2'-O-methyladenosine

SEQ ID NO: 994 - RNA, 34 nt, synthetic construct; identical to SEQ ID NO: 742
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyluridine
  modified_base 4: mod_base = OTHER; note = 2'-O-methylcytidine
  modified_base 5: mod_base = OTHER; note = 2'-O-methylcytidine
  modified_base 6: mod_base = OTHER; note = 2'-O-methyluridine
  modified_base 7: mod_base = OTHER; note = 2'-O-methylcytidine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methylcytidine
  modified_base 11: mod_base = OTHER; note = 2'-O-methyladenosine
  modified_base 12: mod_base = OTHER; note = 2'-O-methylguanosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-O-methylcytidine
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = OTHER; note = 2'-O-methyluridine
  modified_base 21: mod_base = OTHER; note = 2'-O-methylguanosine
  modified_base 22: mod_base = OTHER; note = 2'-fluorouridine
  modified_base 23: mod_base = OTHER; note = 2'-fluorocytidine
  modified_base 24: mod_base = OTHER; note = 2'-fluorouridine
  modified_base 25: mod_base = OTHER; note = 2'-O-methylguanosine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methylguanosine
  modified_base 29: mod_base = OTHER; note = 2'-O-methyladenosine
  modified_base 30: mod_base = OTHER; note = 2'-O-methylguanosine
  modified_base 31: mod_base = OTHER; note = 2'-O-methylguanosine
  modified_base 32: mod_base = OTHER; note = 2'-O-methyladenosine
  modified_base 33: mod_base = OTHER; note = 2'-O-methylguanosine
  modified_base 34: mod_base = OTHER; note = 2'-O-methyladenosine

SEQ ID NO: 995 - RNA, 34 nt, synthetic construct; identical to SEQ ID NO: 743
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methylguanosine
  modified_base 4: mod_base = OTHER; note = 2'-O-methylguanosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methylguanosine
  modified_base 8: mod_base = OTHER; note = 2'-O-methylguanosine
  modified_base 9: mod_base = OTHER; note = 2'-O-methylcytidine
  modified_base 10: mod_base = OTHER; note = 2'-O-methyluridine
  modified_base 11: mod_base = OTHER; note = 2'-O-methylcytidine
  modified_base 12: mod_base = OTHER; note = 2'-O-methylcytidine
  modified_base 13: mod_base = OTHER; note = 2'-O-methylguanosine
  modified_base 14: mod_base = OTHER; note = 2'-fluorouridine
  modified_base 15: mod_base = OTHER; note = 2'-O-methylcytidine
  modified_base 16: mod_base = OTHER; note = 2'-O-methylcytidine
  modified_base 17: mod_base = OTHER; note = 2'-O-methylcytidine
  modified_base 18: mod_base = OTHER; note = 2'-O-methylguanosine
  modified_base 19: mod_base = OTHER; note = 2'-O-methylcytidine
  modified_base 20: mod_base = OTHER; note = 2'-O-methylguanosine
  modified_base 21: mod_base = OTHER; note = 2'-O-methyladenosine
  modified_base 22: mod_base = OTHER; note = 2'-fluorocytidine
  modified_base 23: mod_base = OTHER; note = 2'-fluoroguanosine
  modified_base 24: mod_base = OTHER; note = 2'-fluoroguanosine
  modified_base 25: mod_base = OTHER; note = 2'-O-methyladenosine
  modified_base 26: mod_base = OTHER; note = 2'-O-methylguanosine
  modified_base 27: mod_base = OTHER; note = 2'-O-methylcytidine
  modified_base 28: mod_base = OTHER; note = 2'-O-methylcytidine
  modified_base 29: mod_base = OTHER; note = 2'-O-methyluridine
  modified_base 30: mod_base = OTHER; note = 2'-O-methyluridine
  modified_base 31: mod_base = OTHER; note = 2'-O-methylcytidine
  modified_base 32: mod_base = OTHER; note = 2'-O-methylcytidine
  modified_base 33: mod_base = OTHER; note = 2'-O-methyluridine
  modified_base 34: mod_base = OTHER; note = 2'-O-methyladenosine

SEQ ID NO: 996 - RNA, 34 nt, synthetic construct; identical to SEQ ID NO: 744
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methylguanosine
  modified_base 4: mod_base = OTHER; note = 2'-O-methylcytidine
  modified_base 5: mod_base = OTHER; note = 2'-O-methylcytidine
  modified_base 6: mod_base = OTHER; note = 2'-O-methyladenosine
  modified_base 7: mod_base = OTHER; note = 2'-O-methylguanosine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyluridine
  modified_base 11: mod_base = OTHER; note = 2'-O-methylcytidine
  modified_base 12: mod_base = OTHER; note = 2'-O-methyladenosine
  modified_base 13: mod_base = OTHER; note = 2'-O-methylcytidine
  modified_base 14: mod_base = OTHER; note = 2'-fluorocytidine
  modified_base 15: mod_base = OTHER; note = 2'-O-methyluridine
  modified_base 16: mod_base = OTHER; note = 2'-O-methylcytidine
  modified_base 17: mod_base = OTHER; note = 2'-O-methyluridine
  modified_base 18: mod_base = OTHER; note = 2'-O-methylguanosine
  modified_base 19: mod_base = OTHER; note = 2'-O-methylcytidine
  modified_base 20: mod_base = OTHER; note = 2'-O-methyladenosine
  modified_base 21: mod_base = OTHER; note = 2'-O-methylguanosine
  modified_base 22: mod_base = OTHER; note = 2'-fluoroguanosine
  modified_base 23: mod_base = OTHER; note = 2'-fluorouridine
  modified_base 24: mod_base = OTHER; note = 2'-fluoroguanosine
  modified_base 25: mod_base = OTHER; note = 2'-O-methyladenosine
  modified_base 26: mod_base = OTHER; note = 2'-O-methyluridine
  modified_base 27: mod_base = OTHER; note = 2'-O-methyluridine
  modified_base 28: mod_base = OTHER; note = 2'-O-methylcytidine
  modified_base 29: mod_base = OTHER; note = 2'-O-methyluridine
  modified_base 30: mod_base = OTHER; note = 2'-O-methylguanosine
  modified_base 31: mod_base = OTHER; note = 2'-O-methylguanosine
  modified_base 32: mod_base = OTHER; note = 2'-O-methylcytidine
  modified_base 33: mod_base = OTHER; note = 2'-O-methylguanosine
  modified_base 34: mod_base = OTHER; note = 2'-O-methyladenosine

SEQ ID NO: 997 - RNA, 34 nt, synthetic construct; identical to SEQ ID NO: 745
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methylguanosine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methylguanosine
  modified_base 8: mod_base = OTHER; note = 2'-O-methyladenosine
  modified_base 9: mod_base = OTHER; note = 2'-O-methylguanosine
  modified_base 10: mod_base = OTHER; note = 2'-O-methyladenosine
  modified_base 11: mod_base = OTHER; note = 2'-O-methyluridine
  modified_base 12: mod_base = OTHER; note = 2'-O-methylcytidine
  modified_base 13: mod_base = OTHER; note = 2'-O-methyluridine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-O-methyluridine
  modified_base 17: mod_base = OTHER; note = 2'-O-methylcytidine
  modified_base 18: mod_base = OTHER; note = 2'-O-methyladenosine
  modified_base 19: mod_base = OTHER; note = 2'-O-methylcytidine
  modified_base 20: mod_base = OTHER; note = 2'-O-methyluridine
  modified_base 21: mod_base = OTHER; note = 2'-O-methylguanosine
  modified_base 22: mod_base = OTHER; note = 2'-fluoroadenosine
  modified_base 23: mod_base = OTHER; note = 2'-fluoroguanosine
  modified_base 24: mod_base = OTHER; note = 2'-fluoroadenosine
  modified_base 25: mod_base = OTHER; note = 2'-O-methyluridine
  modified_base 26: mod_base = OTHER; note = 2'-O-methylcytidine
  modified_base 27: mod_base = OTHER; note = 2'-O-methyluridine
  modified_base 28: mod_base = OTHER; note = 2'-O-methylcytidine
  modified_base 29: mod_base = OTHER; note = 2'-O-methyluridine
  modified_base 30: mod_base = OTHER; note = 2'-O-methyluridine
  modified_base 31: mod_base = OTHER; note = 2'-O-methyluridine
  modified_base 32: mod_base = OTHER; note = 2'-O-methylcytidine
  modified_base 33: mod_base = OTHER; note = 2'-O-methylcytidine
  modified_base 34: mod_base = OTHER; note = 2'-O-methyladenosine

SEQ ID NO: 998 - RNA, 34 nt, synthetic construct; identical to SEQ ID NO: 746
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-O-methylguanosine
  modified_base 5: mod_base = OTHER; note = 2'-O-methyluridine
  modified_base 6: mod_base = OTHER; note = 2'-O-methylcytidine
  modified_base 7: mod_base = OTHER; note = 2'-O-methylcytidine
  modified_base 8: mod_base = OTHER; note = 2'-O-methylcytidine
  modified_base 9: mod_base = OTHER; note = 2'-O-methylguanosine
  modified_base 10: mod_base = OTHER; note = 2'-O-methylguanosine
  modified_base 11: mod_base = OTHER; note = 2'-O-methyladenosine
  modified_base 12: mod_base = OTHER; note = 2'-O-methyluridine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methylcytidine
  modified_base 16: mod_base = OTHER; note = 2'-O-methyladenosine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methyladenosine
  modified_base 20: mod_base = OTHER; note = 2'-O-methylguanosine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluoroadenosine
  modified_base 24: mod_base = OTHER; note = 2'-fluorouridine
  modified_base 25: mod_base = OTHER; note = 2'-O-methylcytidine
  modified_base 26: mod_base = OTHER; note = 2'-O-methylcytidine
  modified_base 27: mod_base = OTHER; note = 2'-O-methylguanosine
  modified_base 28: mod_base = OTHER; note = 2'-O-methylguanosine
  modified_base 29: mod_base = OTHER; note = 2'-O-methylguanosine
  modified_base 30: mod_base = OTHER; note = 2'-O-methyladenosine
  modified_base 31: mod_base = OTHER; note = 2'-O-methylcytidine
  modified_base 32: mod_base = OTHER; note = 2'-O-methyluridine
  modified_base 33: mod_base = OTHER; note = 2'-O-methyluridine
  modified_base 34: mod_base = OTHER; note = 2'-O-methyladenosine

SEQ ID NO: 999 - RNA, 34 nt, synthetic construct; identical to SEQ ID NO: 747
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-O-methylguanosine
  modified_base 5: mod_base = OTHER; note = 2'-O-methylcytidine
  modified_base 6: mod_base = OTHER; note = 2'-O-methyluridine
  modified_base 7: mod_base = OTHER; note = 2'-O-methyluridine
  modified_base 8: mod_base = OTHER; note = 2'-O-methylguanosine
  modified_base 9: mod_base = OTHER; note = 2'-O-methyladenosine
  modified_base 10: mod_base = OTHER; note = 2'-O-methyluridine
  modified_base 11: mod_base = OTHER; note = 2'-O-methylcytidine
  modified_base 12: mod_base = OTHER; note = 2'-O-methyladenosine
  modified_base 13: mod_base = OTHER; note = 2'-O-methylguanosine
  modified_base 14: mod_base = OTHER; note = 2'-fluoroguanosine
  modified_base 15: mod_base = OTHER; note = 2'-O-methylguanosine
  modified_base 16: mod_base = OTHER; note = 2'-O-methylcytidine
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methylcytidine
  modified_base 20: mod_base = OTHER; note = 2'-O-methylcytidine
  modified_base 21: mod_base = OTHER; note = 2'-O-methylcytidine
  modified_base 22: mod_base = OTHER; note = 2'-fluorocytidine
  modified_base 23: mod_base = OTHER; note = 2'-fluorouridine
  modified_base 24: mod_base = OTHER; note = 2'-fluoroguanosine
  modified_base 25: mod_base = OTHER; note = 2'-O-methyladenosine
  modified_base 26: mod_base = OTHER; note = 2'-O-methyluridine
  modified_base 27: mod_base = OTHER; note = 2'-O-methylcytidine
  modified_base 28: mod_base = OTHER; note = 2'-O-methyladenosine
  modified_base 29: mod_base = OTHER; note = 2'-O-methyladenosine
  modified_base 30: mod_base = OTHER; note = 2'-O-methylguanosine
  modified_base 31: mod_base = OTHER; note = 2'-O-methylcytidine
  modified_base 32: mod_base = OTHER; note = 2'-O-methyluridine
  modified_base 33: mod_base = OTHER; note = 2'-O-methylcytidine
  modified_base 34: mod_base = OTHER; note = 2'-O-methyladenosine

SEQ ID NO: 1000 - RNA, 34 nt, synthetic construct; identical to SEQ ID NO: 748
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methyluridine
  modified_base 4: mod_base = OTHER; note = 2'-O-methyluridine
  modified_base 5: mod_base = OTHER; note = 2'-O-methylguanosine
  modified_base 6: mod_base = OTHER; note = 2'-O-methylcytidine
  modified_base 7: mod_base = OTHER; note = 2'-O-methyluridine
  modified_base 8: mod_base = OTHER; note = 2'-O-methylcytidine
  modified_base 9: mod_base = OTHER; note = 2'-O-methyladenosine
  modified_base 10: mod_base = OTHER; note = 2'-O-methyluridine
  modified_base 11: mod_base = OTHER; note = 2'-O-methyluridine
  modified_base 12: mod_base = OTHER; note = 2'-O-methylguanosine
  modified_base 13: mod_base = OTHER; note = 2'-O-methyluridine
  modified_base 14: mod_base = OTHER; note = 2'-fluorocytidine
  modified_base 15: mod_base = OTHER; note = 2'-O-methyluridine
  modified_base 16: mod_base = OTHER; note = 2'-O-methyluridine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methyluridine
  modified_base 20: mod_base = OTHER; note = 2'-O-methyladenosine
  modified_base 21: mod_base = OTHER; note = 2'-O-methylguanosine
  modified_base 22: mod_base = OTHER; note = 2'-fluoroadenosine
  modified_base 23: mod_base = OTHER; note = 2'-fluorocytidine
  modified_base 24: mod_base = OTHER; note = 2'-fluoroadenosine
  modified_base 25: mod_base = OTHER; note = 2'-O-methyladenosine
  modified_base 26: mod_base = OTHER; note = 2'-O-methyluridine
  modified_base 27: mod_base = OTHER; note = 2'-O-methylguanosine
  modified_base 28: mod_base = OTHER; note = 2'-O-methyladenosine
  modified_base 29: mod_base = OTHER; note = 2'-O-methylguanosine
  modified_base 30: mod_base = OTHER; note = 2'-O-methylcytidine
  modified_base 31: mod_base = OTHER; note = 2'-O-methyladenosine
  modified_base 32: mod_base = OTHER; note = 2'-O-methyladenosine
  modified_base 33: mod_base = OTHER; note = 2'-O-methylcytidine
  modified_base 34: mod_base = OTHER; note = 2'-O-methyladenosine

SEQ ID NO: 1001 - RNA, 34 nt, synthetic construct; identical to SEQ ID NO: 749
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylguanosine
  modified_base 4: mod_base = OTHER; note = 2'-O-methylcytidine
  modified_base 5: mod_base = OTHER; note = 2'-O-methyluridine
  modified_base 6: mod_base = OTHER; note = 2'-O-methyluridine
  modified_base 7: mod_base = OTHER; note = 2'-O-methylguanosine
  modified_base 8: mod_base = OTHER; note = 2'-O-methyluridine
  modified_base 9: mod_base = OTHER; note = 2'-O-methylguanosine
  modified_base 10: mod_base = OTHER; note = 2'-O-methylguanosine
  modified_base 11: mod_base = OTHER; note = 2'-O-methyluridine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methylcytidine
  modified_base 16: mod_base = OTHER; note = 2'-O-methylguanosine
  modified_base 17: mod_base = OTHER; note = 2'-O-methylguanosine
  modified_base 18: mod_base = OTHER; note = 2'-O-methyluridine
  modified_base 19: mod_base = OTHER; note = 2'-O-methyladenosine
  modified_base 20: mod_base = OTHER; note = 2'-O-methylguanosine
  modified_base 21: mod_base = OTHER; note = 2'-O-methyladenosine
  modified_base 22: mod_base = OTHER; note = 2'-fluorouridine
  modified_base 23: mod_base = OTHER; note = 2'-fluorouridine
  modified_base 24: mod_base = OTHER; note = 2'-fluoroadenosine
  modified_base 25: mod_base = OTHER; note = 2'-O-methylcytidine
  modified_base 26: mod_base = OTHER; note = 2'-O-methylcytidine
  modified_base 27: mod_base = OTHER; note = 2'-O-methyladenosine
  modified_base 28: mod_base = OTHER; note = 2'-O-methylcytidine
  modified_base 29: mod_base = OTHER; note = 2'-O-methyladenosine
  modified_base 30: mod_base = OTHER; note = 2'-O-methyladenosine
  modified_base 31: mod_base = OTHER; note = 2'-O-methylguanosine
  modified_base 32: mod_base = OTHER; note = 2'-O-methylcytidine
  modified_base 33: mod_base = OTHER; note = 2'-O-methyladenosine
  modified_base 34: mod_base = OTHER; note = 2'-O-methyladenosine

SEQ ID NO: 1002 - RNA, 34 nt, synthetic construct; identical to SEQ ID NO: 750
  source 1..34: mol_type = other RNA
  modified_base 1: mod_base = OTHER; note = Phosphorylated 2'-O-methyluridine
  modified_base 2: mod_base = OTHER; note = 2'-fluorouridine
  modified_base 3: mod_base = OTHER; note = 2'-O-methylcytidine
  modified_base 4: mod_base = OTHER; note = 2'-O-methyladenosine
  modified_base 5: mod_base = OTHER; note = 2'-O-methyluridine
  modified_base 6: mod_base = OTHER; note = 2'-O-methylcytidine
  modified_base 7: mod_base = OTHER; note = 2'-O-methyladenosine
  modified_base 8: mod_base = OTHER; note = 2'-O-methylcytidine
  modified_base 9: mod_base = OTHER; note = 2'-O-methyluridine
  modified_base 10: mod_base = OTHER; note = 2'-O-methylcytidine
  modified_base 11: mod_base = OTHER; note = 2'-O-methyladenosine
  modified_base 12: mod_base = OTHER; note = 2'-O-methylcytidine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyluridine
  modified_base 16: mod_base = OTHER; note = 2'-O-methylguanosine
  modified_base 17: mod_base = OTHER; note = 2'-O-methyluridine
  modified_base 18: mod_base = OTHER; note = 2'-O-methyladenosine
  modified_base 19: mod_base = OTHER; note = 2'-O-methylguanosine
  modified_base 20: mod_base = OTHER; note = 2'-O-methyladenosine
  modified_base 21: mod_base = OTHER; note = 2'-O-methyladenosine
  modified_base 22: mod_base = OTHER; note = 2'-fluorouridine
  modified_base 23: mod_base = OTHER; note = 2'-fluoroguanosine
  modified_base 24: mod_base = OTHER; note = 2'-fluorouridine
  modified_base 25: mod_base = OTHER; note = 2'-O-methylguanosine
  modified_base 26: mod_base = OTHER; note = 2'-O-methyladenosine
  modified_base 27: mod_base = OTHER; note = 2'-O-methylguanosine
  modified_base 28: mod_base = OTHER; note = 2'-O-methyluridine
  modified_base 29: mod_base = OTHER; note = 2'-O-methylguanosine
  modified_base 30: mod_base = OTHER; note = 2'-O-methyladenosine
  modified_base 31: mod_base = OTHER; note = 2'-O-methyluridine
  modified_base 32: mod_base = OTHER; note = 2'-O-methylguanosine
  modified_base 33: mod_base = OTHER; note = 2'-O-methyladenosine
  modified_base 34: mod_base = OTHER; note = 2'-O-methyladenosine

SEQ ID NO: 1003 - RNA, 34 nt, synthetic construct; identical to SEQ ID NO: 751
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-O-methylguanosine
  modified_base 5: mod_base = OTHER; note = 2'-O-methyluridine
  modified_base 6: mod_base = OTHER; note = 2'-O-methylguanosine
  modified_base 7: mod_base = OTHER; note = 2'-O-methyluridine
  modified_base 8: mod_base = OTHER; note = 2'-O-methylcytidine
  modified_base 9: mod_base = OTHER; note = 2'-O-methylcytidine
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-O-methylguanosine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methylcytidine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluoroguanosine
  modified_base 23: mod_base = OTHER; note = 2'-fluorocytidine
  modified_base 24: mod_base = OTHER; note = 2'-fluorouridine
  modified_base 25: mod_base = OTHER; note = 2'-O-methyluridine
  modified_base 26: mod_base = OTHER; note = 2'-O-methylguanosine
  modified_base 27: mod_base = OTHER; note = 2'-O-methylguanosine
  modified_base 28: mod_base = OTHER; note = 2'-O-methyladenosine
  modified_base 29: mod_base = OTHER; note = 2'-O-methylcytidine
  modified_base 30: mod_base = OTHER; note = 2'-O-methyladenosine
  modified_base 31: mod_base = OTHER; note = 2'-O-methylcytidine
  modified_base 32: mod_base = OTHER; note = 2'-O-methyluridine
  modified_base 33: mod_base = OTHER; note = 2'-O-methylguanosine
  modified_base 34: mod_base = OTHER; note = 2'-O-methyladenosine

SEQ ID NO: 1004 - RNA, 34 nt, synthetic construct; identical to SEQ ID NO: 752
  source 1..34: mol_type = other RNA
  modified_base 1: mod_base = OTHER; note = Phosphorylated 2'-O-methyluridine
  modified_base 2: mod_base = OTHER; note = 2'-fluorocytidine
  modified_base 3: mod_base = OTHER; note = 2'-O-methylcytidine
  modified_base 4: mod_base = OTHER; note = 2'-O-methyladenosine
  modified_base 5: mod_base = OTHER; note = 2'-O-methyluridine
  modified_base 6: mod_base = OTHER; note = 2'-O-methyluridine
  modified_base 7: mod_base = OTHER; note = 2'-O-methylcytidine
  modified_base 8: mod_base = OTHER; note = 2'-O-methyluridine
  modified_base 9: mod_base = OTHER; note = 2'-O-methyluridine
  modified_base 10: mod_base = OTHER; note = 2'-O-methylguanosine
  modified_base 11: mod_base = OTHER; note = 2'-O-methyladenosine
  modified_base 12: mod_base = OTHER; note = 2'-O-methyluridine
  modified_base 13: mod_base = OTHER; note = 2'-O-methylguanosine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-O-methylguanosine
  modified_base 17: mod_base = OTHER; note = 2'-O-methyladenosine
  modified_base 18: mod_base = OTHER; note = 2'-O-methylcytidine
  modified_base 19: mod_base = OTHER; note = 2'-O-methylcytidine
  modified_base 20: mod_base = OTHER; note = 2'-O-methyluridine
  modified_base 21: mod_base = OTHER; note = 2'-O-methyladenosine
  modified_base 22: mod_base = OTHER; note = 2'-fluorocytidine
  modified_base 23: mod_base = OTHER; note = 2'-fluoroadenosine
  modified_base 24: mod_base = OTHER; note = 2'-fluorouridine
  modified_base 25: mod_base = OTHER; note = 2'-O-methylcytidine
  modified_base 26: mod_base = OTHER; note = 2'-O-methyladenosine
  modified_base 27: mod_base = OTHER; note = 2'-O-methyladenosine
  modified_base 28: mod_base = OTHER; note = 2'-O-methylguanosine
  modified_base 29: mod_base = OTHER; note = 2'-O-methyladenosine
  modified_base 30: mod_base = OTHER; note = 2'-O-methyladenosine
  modified_base 31: mod_base = OTHER; note = 2'-O-methyluridine
  modified_base 32: mod_base = OTHER; note = 2'-O-methylguanosine
  modified_base 33: mod_base = OTHER; note = 2'-O-methylguanosine
  modified_base 34: mod_base = OTHER; note = 2'-O-methyladenosine

SEQ ID NO: 1005 - RNA, 34 nt, synthetic construct; identical to SEQ ID NO: 753
  source 1..34: mol_type = other RNA
  modified_base 1: mod_base = OTHER; note = Phosphorylated 2'-O-methyluridine
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-O-methylcytidine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyluridine
  modified_base 8: mod_base = OTHER; note = 2'-O-methylguanosine
  modified_base 9: mod_base = OTHER; note = 2'-O-methyluridine
  modified_base 10: mod_base = OTHER; note = 2'-O-methylguanosine
  modified_base 11: mod_base = OTHER; note = 2'-O-methylcytidine
  modified_base 12: mod_base = OTHER; note = 2'-O-methyluridine
  modified_base 13: mod_base = OTHER; note = 2'-O-methylguanosine
  modified_base 14: mod_base = OTHER; note = 2'-fluorocytidine
  modified_base 15: mod_base = OTHER; note = 2'-O-methyluridine
  modified_base 16: mod_base = OTHER; note = 2'-O-methylguanosine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methylguanosine
  modified_base 22: mod_base = OTHER; note = 2'-fluorocytidine
  modified_base 23: mod_base = OTHER; note = 2'-fluoroadenosine
  modified_base 24: mod_base = OTHER; note = 2'-fluoroguanosine
  modified_base 25: mod_base = OTHER; note = 2'-O-methylcytidine
  modified_base 26: mod_base = OTHER; note = 2'-O-methyladenosine
  modified_base 27: mod_base = OTHER; note = 2'-O-methylcytidine
  modified_base 28: mod_base = OTHER; note = 2'-O-methyladenosine
  modified_base 29: mod_base = OTHER; note = 2'-O-methyluridine
  modified_base 30: mod_base = OTHER; note = 2'-O-methyluridine
  modified_base 31: mod_base = OTHER; note = 2'-O-methylguanosine
  modified_base 32: mod_base = OTHER; note = 2'-O-methyluridine
  modified_base 33: mod_base = OTHER; note = 2'-O-methyluridine
  modified_base 34: mod_base = OTHER; note = 2'-O-methyladenosine

SEQ ID NO: 1006 - RNA, 34 nt, synthetic construct; identical to SEQ ID NO: 754
  source 1..34: mol_type = other RNA
  modified_base 1: mod_base = OTHER; note = Phosphorylated 2'-O-methyluridine
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-O-methylcytidine
  modified_base 5: mod_base = OTHER; note = 2'-O-methyluridine
  modified_base 6: mod_base = OTHER; note = 2'-O-methyluridine
  modified_base 7: mod_base = OTHER; note = 2'-O-methylcytidine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methylcytidine
  modified_base 11: mod_base = OTHER; note = 2'-O-methyluridine
  modified_base 12: mod_base = OTHER; note = 2'-O-methyluridine
  modified_base 13: mod_base = OTHER; note = 2'-O-methylguanosine
  modified_base 14: mod_base = OTHER; note = 2'-fluorouridine
  modified_base 15: mod_base = OTHER; note = 2'-O-methylguanosine
  modified_base 16: mod_base = OTHER; note = 2'-O-methylguanosine
  modified_base 17: mod_base = OTHER; note = 2'-O-methyluridine
  modified_base 18: mod_base = OTHER; note = 2'-O-methylcytidine
  modified_base 19: mod_base = OTHER; note = 2'-O-methyluridine
  modified_base 20: mod_base = OTHER; note = 2'-O-methylcytidine
  modified_base 21: mod_base = OTHER; note = 2'-O-methyladenosine
  modified_base 22: mod_base = OTHER; note = 2'-fluorocytidine
  modified_base 23: mod_base = OTHER; note = 2'-fluoroadenosine
  modified_base 24: mod_base = OTHER; note = 2'-fluoroadenosine
  modified_base 25: mod_base = OTHER; note = 2'-O-methylguanosine
  modified_base 26: mod_base = OTHER; note = 2'-O-methyluridine
  modified_base 27: mod_base = OTHER; note = 2'-O-methyluridine
  modified_base 28: mod_base = OTHER; note = 2'-O-methylguanosine
  modified_base 29: mod_base = OTHER; note = 2'-O-methyladenosine
  modified_base 30: mod_base = OTHER; note = 2'-O-methyladenosine
  modified_base 31: mod_base = OTHER; note = 2'-O-methylguanosine
  modified_base 32: mod_base = OTHER; note = 2'-O-methyluridine
  modified_base 33: mod_base = OTHER; note = 2'-O-methylcytidine
  modified_base 34: mod_base = OTHER; note = 2'-O-methyladenosine

SEQ ID NO: 1007 - RNA, 30 nt, synthetic construct; identical to SEQ ID NO: 756
  source 1..30: mol_type = other RNA
  modified_base 1: mod_base = OTHER; note = 2'-O-methyluridine
  modified_base 2: mod_base = OTHER; note = 2'-fluorouridine
  modified_base 3: mod_base = OTHER; note = 2'-O-methylguanosine
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorouridine
  modified_base 7: mod_base = OTHER; note = 2'-O-methylguanosine
  modified_base 8: mod_base = OTHER; note = 2'-fluoroadenosine
  modified_base 9: mod_base = OTHER; note = 2'-O-methyladenosine
  modified_base 10: mod_base = OTHER; note = 2'-fluoroadenosine
  modified_base 11: mod_base = OTHER; note = 2'-O-methylcytidine
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyluridine
  modified_base 16: mod_base = OTHER; note = 2'-fluorouridine
  modified_base 17: mod_base = OTHER; note = 2'-O-methylcytidine
  modified_base 18: mod_base = OTHER; note = 2'-fluorouridine
  modified_base 19: mod_base = OTHER; note = 2'-O-methylcytidine
  modified_base 20: mod_base = OTHER; note = 2'-fluoroguanosine
  modified_base 21: mod_base = OTHER; note = 2'-O-methyluridine
  modified_base 22: mod_base = OTHER; note = 2'-fluorouridine
  modified_base 23: mod_base = OTHER; note = 2'-O-methyluridine
  modified_base 24: mod_base = OTHER; note = 2'-fluorocytidine
  modified_base 25: mod_base = OTHER; note = 2'-O-methyladenosine
  modified_base 26: mod_base = OTHER; note = 2'-fluorouridine
  modified_base 27: mod_base = OTHER; note = 2'-O-methyluridine
  modified_base 28: mod_base = OTHER; note = 2'-fluorocytidine
  modified_base 29: mod_base = OTHER; note = 2'-O-methyladenosine
  modified_base 30: mod_base = OTHER; note = 2'-fluoroadenosine 3x N-acetylgalactosamine

SEQ ID NO: 1008 - RNA, 33 nt, synthetic construct; identical to SEQ ID NO: 755
  source 1..33: mol_type = other RNA
  modified_base 1: mod_base = OTHER; note = 2'-O-methyluridine
  modified_base 2: mod_base = OTHER; note = 2'-fluorouridine
  modified_base 3: mod_base = OTHER; note = 2'-O-methylguanosine
  modified_base 4: mod_base = OTHER; note = 2'-O-methylcytidine
  modified_base 5: mod_base = OTHER; note = 2'-O-methylcytidine
  modified_base 6: mod_base = OTHER; note = 2'-O-methyladenosine
  modified_base 7: mod_base = OTHER; note = 2'-O-methylcytidine
  modified_base 8: mod_base = OTHER; note = 2'-O-methyladenosine
  modified_base 9: mod_base = OTHER; note = 2'-O-methylguanosine
  modified_base 10: mod_base = OTHER; note = 2'-O-methyladenosine
  modified_base 11: mod_base = OTHER; note = 2'-O-methylguanosine
  modified_base 12: mod_base = OTHER; note = 2'-O-methyladenosine
  modified_base 13: mod_base = OTHER; note = 2'-O-methylcytidine
  modified_base 14: mod_base = OTHER; note = 2'-fluorouridine
  modified_base 15: mod_base = OTHER; note = 2'-O-methylcytidine
  modified_base 16: mod_base = OTHER; note = 2'-O-methyladenosine
  modified_base 17: mod_base = OTHER; note = 2'-O-methylguanosine
  modified_base 18: mod_base = OTHER; note = 2'-O-methyladenosine
  modified_base 19: mod_base = OTHER; note = 2'-O-methylguanosine
  modified_base 20: mod_base = OTHER; note = 2'-O-methyladenosine
  modified_base 21: mod_base = OTHER; note = 2'-fluoroguanosine
  modified_base 22: mod_base = OTHER; note = 2'-fluorouridine
  modified_base 23: mod_base = OTHER; note = 2'-fluorocytidine
  modified_base 24: mod_base = OTHER; note = 2'-O-methyluridine
  modified_base 25: mod_base = OTHER; note = 2'-O-methylcytidine
  modified_base 26: mod_base = OTHER; note = 2'-O-methyluridine
  modified_base 27: mod_base = OTHER; note = 2'-O-methylguanosine
  modified_base 28: mod_base = OTHER; note = 2'-O-methyluridine
  modified_base 29: mod_base = OTHER; note = 2'-O-methylguanosine
  modified_base 30: mod_base = OTHER; note = 2'-O-methylguanosine
  modified_base 31: mod_base = OTHER; note = 2'-O-methylcytidine
  modified_base 32: mod_base = OTHER; note = 2'-O-methyladenosine
  modified_base 33: mod_base = OTHER; note = 2'-O-methyladenosine 3x N-acetylgalactosamine

SEQ ID NO: 1009 - RNA, 33 nt, synthetic construct; identical to SEQ ID NO: 755
  source 1..33: mol_type = other RNA
  modified_base 1: mod_base = OTHER; note = 2'-O-methyluridine phosphorothioate
  modified_base 2: mod_base = OTHER; note = 2'-fluorouridine phosphorothioate
  modified_base 3: mod_base = OTHER; note = 2'-O-methylguanosine
  modified_base 4: mod_base = OTHER; note = 2'-O-methylcytidine
  modified_base 5: mod_base = OTHER; note = 2'-O-methylcytidine
  modified_base 6: mod_base = OTHER; note = 2'-O-methyladenosine
  modified_base 7: mod_base = OTHER; note = 2'-O-methylcytidine
  modified_base 8: mod_base = OTHER; note = 2'-O-methyladenosine
  modified_base 9: mod_base = OTHER; note = 2'-O-methylguanosine
  modified_base 10: mod_base = OTHER; note = 2'-O-methyladenosine
  modified_base 11: mod_base = OTHER; note = 2'-O-methylguanosine
  modified_base 12: mod_base = OTHER; note = 2'-O-methyladenosine
  modified_base 13: mod_base = OTHER; note = 2'-O-methylcytidine
  modified_base 14: mod_base = OTHER; note = 2'-fluorouridine phosphorothioate
  modified_base 15: mod_base = OTHER; note = 2'-O-methylcytidine phosphorothioate
  modified_base 16: mod_base = OTHER; note = 2'-O-methyladenosine phosphorothioate
  modified_base 17: mod_base = OTHER; note = 2'-O-methylguanosine phosphorothioate
  modified_base 18: mod_base = OTHER; note = 2'-O-methyladenosine phosphorothioate
  modified_base 19: mod_base = OTHER; note = 2'-O-methylguanosine phosphorothioate
  modified_base 20: mod_base = OTHER; note = 2'-O-methyladenosine
  modified_base 21: mod_base = OTHER; note = 2'-fluoroguanosine
  modified_base 22: mod_base = OTHER; note = 2'-fluorouridine
  modified_base 23: mod_base = OTHER; note = 2'-fluorocytidine
  modified_base 24: mod_base = OTHER; note = 2'-O-methyluridine
  modified_base 25: mod_base = OTHER; note = 2'-O-methylcytidine
  modified_base 26: mod_base = OTHER; note = 2'-O-methyluridine
  modified_base 27: mod_base = OTHER; note = 2'-O-methylguanosine
  modified_base 28: mod_base = OTHER; note = 2'-O-methyluridine
  modified_base 29: mod_base = OTHER; note = 2'-O-methylguanosine
  modified_base 30: mod_base = OTHER; note = 2'-O-methylguanosine
  modified_base 31: mod_base = OTHER; note = 2'-O-methylcytidine phosphorothioate
  modified_base 32: mod_base = OTHER; note = 2'-O-methyladenosine phosphorothioate
  modified_base 33: mod_base = OTHER; note = 2'-O-methyladenosine phosphorothioate Sirnaomics N-acetylgalactosamine Sirnaomics N-acetylgalactosamine Sirnaomics N-acetylgalactosamine

SEQ ID NO: 1010 - RNA, 30 nt, synthetic construct; identical to SEQ ID NO: 756
  source 1..30: mol_type = other RNA
  modified_base 1: mod_base = OTHER; note = 2'-O-methyluridine phosphorothioate
  modified_base 2: mod_base = OTHER; note = 2'-fluorouridine phosphorothioate
  modified_base 3: mod_base = OTHER; note = 2'-O-methylguanosine
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorouridine
  modified_base 7: mod_base = OTHER; note = 2'-O-methylguanosine
  modified_base 8: mod_base = OTHER; note = 2'-fluoroadenosine
  modified_base 9: mod_base = OTHER; note = 2'-O-methyladenosine
  modified_base 10: mod_base = OTHER; note = 2'-fluoroadenosine
  modified_base 11: mod_base = OTHER; note = 2'-O-methylcytidine
  modified_base 12: mod_base = OTHER; note = 2'-fluoroguanosine
  modified_base 13: mod_base = OTHER; note = 2'-O-methyladenosine phosphorothioate
  modified_base 14: mod_base = OTHER; note = 2'-fluorocytidine phosphorothioate
  modified_base 15: mod_base = OTHER; note = 2'-O-methyluridine phosphorothioate
  modified_base 16: mod_base = OTHER; note = 2'-fluorouridine phosphorothioate
  modified_base 17: mod_base = OTHER; note = 2'-O-methylcytidine phosphorothioate
  modified_base 18: mod_base = OTHER; note = 2'-fluorouridine phosphorothioate
  modified_base 19: mod_base = OTHER; note = 2'-O-methylcytidine
  modified_base 20: mod_base = OTHER; note = 2'-fluoroguanosine
  modified_base 21: mod_base = OTHER; note = 2'-O-methyluridine
  modified_base 22: mod_base = OTHER; note = 2'-fluorouridine
  modified_base 23: mod_base = OTHER; note = 2'-O-methyluridine
  modified_base 24: mod_base = OTHER; note = 2'-fluorocytidine
  modified_base 25: mod_base = OTHER; note = 2'-O-methyladenosine
  modified_base 26: mod_base = OTHER; note = 2'-fluorouridine
  modified_base 27: mod_base = OTHER; note = 2'-O-methyluridine
  modified_base 28: mod_base = OTHER; note = 2'-fluorocytidine phosphorothioate
  modified_base 29: mod_base = OTHER; note = 2'-O-methyladenosine phosphorothioate
  modified_base 30: mod_base = OTHER; note = 2'-fluoroadenosine phosphorothioate Sirnaomics N-acetylgalactosamine Sirnaomics N-acetylgalactosamine Sirnaomics N-acetylgalactosamine

The invention claimed is:

1. An siRNA compound that inhibits complement factor B (CFB), comprising (a) a first nucleobase sequence that is SEQ ID NO:251 linked directly to a second nucleobase sequence that is SEQ ID NO:503, or (b) a first nucleobase sequence that is SEQ ID NO:252 linked directly to a second nucleobase sequence that is SEQ ID NO:504;

wherein said compound is 30 or 33 nucleosides long, wherein optionally at least one sugar in the siRNA is modified, and wherein optionally at least one internucleoside linkage is modified.

2. The siRNA according to claim 1, having the sequence of SEQ ID NO:755.

3. The siRNA according to claim 1, having the sequence of SEQ ID NO:756.

4. The siRNA according to claim 1, which further comprises one or more ligands, wherein said ligand optionally comprises at least one carbohydrate.

5. The siRNA according to claim 4, wherein said one or more carbohydrates comprise one or more N-Acetyl-Galactosamine moieties.

6. The siRNA according to claim 1, wherein sugars of the nucleosides at any of positions 2 and 14 downstream from the first nucleoside of the 5' end do not contain 2'-O-methyl modifications.

7. The siRNA according to claim 1, wherein sugars of the nucleosides at any of positions 9 to 11 downstream from the first nucleoside of the 5' end contain 2'-F modifications.

8. A pharmaceutical composition comprising a compound according to claim 1, and a physiologically acceptable excipient.

9. A method of treating a disease or disorder, comprising administering to a subject suffering from said disorder an effective amount of a compound according to claim 1, wherein said disease or disorder is selected from autoimmune disease, complement system dysfunction including aberrant upregulation of complement components such as CFB, age-related macular degeneration (AMD) including dry AMD and geographic atrophy, paroxysmal nocturnal hemoglobinuria (PNH), atypical hemolytic uremic syndrome (aHUS), C3 glomerulopathy (C3G), Ig-mediated kidney pathologies such as IgA nephropathy and primary membranous nephropathy, asthma, rheumatic disease, rheumatoid arthritis, systemic lupus erythematosus (SLE), anti-neutrophil cytoplasmic antibody (ANCA) vasculitis, antiphospholipid antibody syndrome (APS), glomerulonephritis, psoriasis, dermatomyositis bullous pemphigoid, Shiga toxin *E. coli*-related hemolytic uremic syndrome, myasthenia gravis (MG), neuromyelistis optica (NMO), dense deposit disease, C3 neuropathy, cold agglutinin disease, humoral and vascular transplant rejection, graft dysfunction, myocardial infarction, sensitization towards a transplant, and sepsis.

* * * * *